United States Patent
Ader et al.

(10) Patent No.: US 9,422,558 B2
(45) Date of Patent: Aug. 23, 2016

(54) METHODS AND COMPOSITIONS FOR WEED CONTROL

(75) Inventors: Daniel Ader, St. Louis, MO (US); John J Fiinnessy, Des Peres, MO (US); Zhaolong Li, St. Charles, MO (US); James D Masucci, Manchester, MO (US); Ronak Hasmukh Shah, Chesterfield, MO (US); Nengbing Tao, O'Fallon, MO (US); Jennifer Chou Taylor, Ballwin, MO (US)

(73) Assignee: Monsanto Technology LLC, St. Louis, MO (US)

( * ) Notice: Subject to any disclaimer, the term of this patent is extended or adjusted under 35 U.S.C. 154(b) by 813 days.

(21) Appl. No.: 13/612,948

(22) Filed: Sep. 13, 2012

(65) Prior Publication Data

US 2013/0247247 A1   Sep. 19, 2013

Related U.S. Application Data

(60) Provisional application No. 61/534,076, filed on Sep. 13, 2011.

(51) Int. Cl.
| | | |
|---|---|---|
| C12N 15/113 | (2010.01) | |
| C12N 15/82 | (2006.01) | |
| A01N 57/16 | (2006.01) | |
| A01N 57/20 | (2006.01) | |
| A01H 3/04 | (2006.01) | |
| A01N 63/00 | (2006.01) | |
| C12N 9/00 | (2006.01) | |

(52) U.S. Cl.
CPC ............. *C12N 15/1137* (2013.01); *A01H 3/04* (2013.01); *A01N 57/16* (2013.01); *A01N 57/20* (2013.01); *A01N 63/00* (2013.01); *C12N 9/93* (2013.01); *C12N 15/8218* (2013.01); *C12N 15/8251* (2013.01); *C12N 15/8274* (2013.01); *C12Y 603/01002* (2013.01); *C12Y 603/01006* (2013.01)

(58) Field of Classification Search
CPC ..... C12N 15/113; A01N 57/16; A01N 57/20
See application file for complete search history.

(56) References Cited

U.S. PATENT DOCUMENTS

| | | |
|---|---|---|
| 3,687,808 A | 8/1972 | Merigan et al. |
| 3,791,932 A | 2/1974 | Schuurs et al. |
| 3,839,153 A | 10/1974 | Schuurs et al. |
| 3,850,578 A | 11/1974 | McConnell |
| 3,850,752 A | 11/1974 | Schuurs et al. |
| 3,853,987 A | 12/1974 | Dreyer |
| 3,867,517 A | 2/1975 | Ling |
| 3,879,262 A | 4/1975 | Schuurs et al. |
| 3,901,654 A | 8/1975 | Gross |
| 3,935,074 A | 1/1976 | Rubenstein et al. |
| 3,984,533 A | 10/1976 | Uzgiris |
| 3,996,345 A | 12/1976 | Ullman et al. |
| 4,034,074 A | 7/1977 | Miles |
| 4,098,876 A | 7/1978 | Piasio et al. |
| 4,469,863 A | 9/1984 | Ts'o et al. |
| 4,476,301 A | 10/1984 | Imbach et al. |
| 4,535,060 A | 8/1985 | Comai |
| 4,581,847 A | 4/1986 | Hibberd et al. |
| 4,666,828 A | 5/1987 | Gusella |
| 4,683,202 A | 7/1987 | Mullis |
| 4,761,373 A | 8/1988 | Anderson et al. |
| 4,769,061 A | 9/1988 | Comai |
| 4,801,531 A | 1/1989 | Frossard |
| 4,810,648 A | 3/1989 | Stalker |
| 4,879,219 A | 11/1989 | Wands et al. |
| 4,940,835 A | 7/1990 | Shah et al. |
| 4,971,908 A | 11/1990 | Kishore et al. |
| 5,004,863 A | 4/1991 | Umbeck |
| 5,011,771 A | 4/1991 | Bellet et al. |
| 5,013,659 A | 5/1991 | Bedbrook et al. |
| 5,015,580 A | 5/1991 | Christou et al. |
| 5,023,243 A | 6/1991 | Tullis |
| 5,034,506 A | 7/1991 | Summerton et al. |
| 5,094,945 A | 3/1992 | Comai |
| 5,141,870 A | 8/1992 | Bedbrook et al. |
| 5,145,783 A | 9/1992 | Kishore et al. |
| 5,159,135 A | 10/1992 | Umbeck |
| 5,166,315 A | 11/1992 | Summerton et al. |
| 5,177,196 A | 1/1993 | Meyer, Jr. et al. |

(Continued)

FOREIGN PATENT DOCUMENTS

| | | |
|---|---|---|
| CN | 101279950 A | 10/2008 |
| CN | 101279951 A | 10/2008 |

(Continued)

OTHER PUBLICATIONS

Brugiére, Norbert, et al. "Glutamine synthetase in the phloem plays a major role in controlling proline production." The Plant Cell Online 11.10 (1999): 1995-2011.*
Street, 2008, http://biochemistryrevisited.blogspot.com/2008/01/why-is-dna-and-not-rna-stable-storage.html#!/2008/01/why-is-dna-and-not-rna-stable-storage.html.*
Tank mixing benefit, NCSU, 2004, published online at http://www.ncagr.gov/agronomi/pdffiles/Tank_Mixing.pdf.*
Brugiére, Norbert, et al. "Glutamine synthetase in the phloem plays a major role in controlling proline production." The Plant Cell 11.10 (1999): 1995-2011.*

(Continued)

*Primary Examiner* — Russell Kallis
*Assistant Examiner* — Weihua Fan
(74) *Attorney, Agent, or Firm* — Amanda Carmany-Rampey; David R. Marsh; Arnold & Porter LLP

(57) ABSTRACT

The present invention provides novel compositions for use to enhance weed control. Specifically, the present invention provides for methods and compositions that modulate glutamine synthetase in weed species. The present invention also provides for combinations of compositions and methods that enhance weed control.

28 Claims, No Drawings

(56) References Cited

U.S. PATENT DOCUMENTS

| | | |
|---|---|---|
| 5,185,444 A | 2/1993 | Summerton et al. |
| 5,188,642 A | 2/1993 | Shah et al. |
| 5,188,897 A | 2/1993 | Suhadolnik et al. |
| 5,192,659 A | 3/1993 | Simons |
| 5,214,134 A | 5/1993 | Weis et al. |
| 5,216,141 A | 6/1993 | Benner |
| 5,235,033 A | 8/1993 | Summerton et al. |
| 5,264,423 A | 11/1993 | Cohen et al. |
| 5,264,562 A | 11/1993 | Matteucci |
| 5,264,564 A | 11/1993 | Matteucci |
| 5,272,057 A | 12/1993 | Smulson et al. |
| 5,276,019 A | 1/1994 | Cohen et al. |
| 5,281,521 A | 1/1994 | Trojanowski et al. |
| 5,286,717 A | 2/1994 | Cohen et al. |
| 5,304,732 A | 4/1994 | Anderson et al. |
| 5,310,667 A | 5/1994 | Eichholtz et al. |
| 5,312,910 A | 5/1994 | Kishore et al. |
| 5,321,131 A | 6/1994 | Agrawal et al. |
| 5,331,107 A | 7/1994 | Anderson et al. |
| 5,339,107 A | 8/1994 | Henry et al. |
| 5,346,107 A | 9/1994 | Bouix et al. |
| 5,378,824 A | 1/1995 | Bedbrook et al. |
| 5,390,667 A | 2/1995 | Kumakura et al. |
| 5,392,910 A | 2/1995 | Bell et al. |
| 5,393,175 A | 2/1995 | Courville |
| 5,399,676 A | 3/1995 | Froehler |
| 5,405,938 A | 4/1995 | Summerton et al. |
| 5,405,939 A | 4/1995 | Suhadolnik et al. |
| 5,416,011 A | 5/1995 | Hinchee et al. |
| 5,453,496 A | 9/1995 | Caruthers et al. |
| 5,455,233 A | 10/1995 | Spielvogel et al. |
| 5,460,667 A | 10/1995 | Moriyuki et al. |
| 5,462,910 A | 10/1995 | Ito et al. |
| 5,463,174 A | 10/1995 | Moloney et al. |
| 5,463,175 A | 10/1995 | Barry et al. |
| 5,466,677 A | 11/1995 | Baxter et al. |
| 5,470,967 A | 11/1995 | Huie et al. |
| 5,476,925 A | 12/1995 | Letsinger et al. |
| 5,489,520 A | 2/1996 | Adams et al. |
| 5,489,677 A | 2/1996 | Sanghvi et al. |
| 5,491,288 A | 2/1996 | Chaubet et al. |
| 5,510,471 A | 4/1996 | Lebrun et al. |
| 5,518,908 A | 5/1996 | Corbin et al. |
| 5,519,126 A | 5/1996 | Hecht |
| 5,536,821 A | 7/1996 | Agrawal et al. |
| 5,538,880 A | 7/1996 | Lundquist et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,550,318 A | 8/1996 | Adams et al. |
| 5,550,398 A | 8/1996 | Kocian et al. |
| 5,550,468 A | 8/1996 | Häberlein et al. |
| 5,558,071 A | 9/1996 | Ward et al. |
| 5,561,225 A | 10/1996 | Maddry et al. |
| 5,561,236 A | 10/1996 | Leemans et al. |
| 5,563,253 A | 10/1996 | Agrawal et al. |
| 5,569,834 A | 10/1996 | Hinchee et al. |
| 5,571,799 A | 11/1996 | Tkachuk et al. |
| 5,587,361 A | 12/1996 | Cook et al. |
| 5,591,616 A | 1/1997 | Hiei et al. |
| 5,593,874 A | 1/1997 | Brown et al. |
| 5,596,086 A | 1/1997 | Matteucci et al. |
| 5,602,240 A | 2/1997 | De Mesmaeker et al. |
| 5,605,011 A | 2/1997 | Bedbrook et al. |
| 5,608,046 A | 3/1997 | Cook et al. |
| 5,610,289 A | 3/1997 | Cook et al. |
| 5,618,704 A | 4/1997 | Sanghvi et al. |
| 5,623,070 A | 4/1997 | Cook et al. |
| 5,625,050 A | 4/1997 | Beaton et al. |
| 5,627,061 A | 5/1997 | Barry et al. |
| 5,633,360 A | 5/1997 | Bischofberger et al. |
| 5,633,435 A | 5/1997 | Barry et al. |
| 5,633,448 A | 5/1997 | Lebrun et al. |
| 5,639,024 A | 6/1997 | Mueller et al. |
| 5,646,024 A | 7/1997 | Leemans et al. |
| 5,648,477 A | 7/1997 | Leemans et al. |
| 5,663,312 A | 9/1997 | Chaturvedula |
| 5,677,437 A | 10/1997 | Teng et al. |
| 5,677,439 A | 10/1997 | Weis et al. |
| 5,719,046 A | 2/1998 | Guerineau et al. |
| 5,721,138 A | 2/1998 | Lawn |
| 5,731,180 A | 3/1998 | Dietrich |
| 5,739,180 A | 4/1998 | Taylor-Smith |
| 5,746,180 A | 5/1998 | Jefferson et al. |
| 5,767,361 A | 6/1998 | Dietrich |
| 5,767,373 A | 6/1998 | Ward et al. |
| 5,780,708 A | 7/1998 | Lundquist et al. |
| 5,804,425 A | 9/1998 | Barry et al. |
| 5,824,877 A | 10/1998 | Hinchee et al. |
| 5,837,848 A | 11/1998 | Ely et al. |
| 5,859,347 A | 1/1999 | Brown et al. |
| 5,866,775 A | 2/1999 | Eichholtz et al. |
| 5,874,265 A | 2/1999 | Adams et al. |
| 5,879,903 A | 3/1999 | Strauch et al. |
| 5,914,451 A | 6/1999 | Martinell et al. |
| 5,919,675 A | 7/1999 | Adams et al. |
| 5,928,937 A | 7/1999 | Kakefuda et al. |
| 5,939,602 A | 8/1999 | Volrath et al. |
| 5,969,213 A | 10/1999 | Adams et al. |
| 5,981,840 A | 11/1999 | Zhao et al. |
| 5,985,793 A * | 11/1999 | Sandbrink ............ A01N 25/00 424/405 |
| RE36,449 E | 12/1999 | Lebrun et al. |
| 6,040,497 A | 3/2000 | Spencer et al. |
| 6,056,938 A | 5/2000 | Unger et al. |
| 6,069,115 A | 5/2000 | Pallett et al. |
| 6,084,089 A | 7/2000 | Mine et al. |
| 6,084,155 A | 7/2000 | Volrath et al. |
| 6,118,047 A | 9/2000 | Anderson et al. |
| 6,121,513 A | 9/2000 | Zhang et al. |
| 6,130,366 A | 10/2000 | Herrera-Estrella et al. |
| 6,140,078 A | 10/2000 | Sanders et al. |
| 6,153,812 A | 11/2000 | Fry et al. |
| 6,160,208 A | 12/2000 | Lundquist et al. |
| 6,177,616 B1 | 1/2001 | Bartsch et al. |
| 6,194,636 B1 | 2/2001 | McElroy et al. |
| 6,225,105 B1 | 5/2001 | Sathasivan et al. |
| 6,225,114 B1 | 5/2001 | Eichholtz et al. |
| 6,232,526 B1 | 5/2001 | McElroy et al. |
| 6,245,968 B1 | 6/2001 | Boudec et al. |
| 6,248,876 B1 | 6/2001 | Barry et al. |
| 6,252,138 B1 | 6/2001 | Karimi et al. |
| RE37,287 E | 7/2001 | Lebrun et al. |
| 6,268,549 B1 | 7/2001 | Sailland et al. |
| 6,271,359 B1 | 8/2001 | Norris et al. |
| 6,282,837 B1 | 9/2001 | Ward et al. |
| 6,288,306 B1 | 9/2001 | Ward et al. |
| 6,288,312 B1 | 9/2001 | Christou et al. |
| 6,294,714 B1 | 9/2001 | Matsunaga et al. |
| 6,326,193 B1 | 12/2001 | Liu et al. |
| 6,329,571 B1 | 12/2001 | Hiei |
| 6,348,185 B1 | 2/2002 | Piwnica-Worms |
| 6,365,807 B1 | 4/2002 | Christou et al. |
| 6,384,301 B1 | 5/2002 | Martinell et al. |
| 6,385,902 B1 | 5/2002 | Schipper et al. |
| 6,399,861 B1 | 6/2002 | Anderson et al. |
| 6,403,865 B1 | 6/2002 | Koziel et al. |
| 6,414,222 B1 | 7/2002 | Gengenbach et al. |
| 6,421,956 B1 | 7/2002 | Boukens et al. |
| 6,426,446 B1 | 7/2002 | McElroy et al. |
| 6,433,252 B1 | 8/2002 | Kriz et al. |
| 6,437,217 B1 | 8/2002 | McElroy et al. |
| 6,453,609 B1 | 9/2002 | Soll et al. |
| 6,642,435 B1 | 11/2003 | Rafalski et al. |
| 6,644,341 B1 | 11/2003 | Chemo et al. |
| 6,768,044 B1 | 7/2004 | Boudec et al. |
| 6,992,237 B1 | 1/2006 | Habben et al. |
| 7,022,896 B1 | 4/2006 | Weeks et al. |
| 7,026,528 B2 | 4/2006 | Cheng et al. |
| RE39,247 E | 8/2006 | Barry et al. |
| 7,105,724 B2 | 9/2006 | Weeks et al. |
| 7,297,541 B2 | 11/2007 | Moshiri et al. |
| 7,304,209 B2 | 12/2007 | Zink et al. |
| 7,312,379 B2 | 12/2007 | Andrews et al. |

(56) References Cited

U.S. PATENT DOCUMENTS

| | | |
|---|---|---|
| 7,323,310 B2 | 1/2008 | Peters et al. |
| 7,371,927 B2 | 5/2008 | Yao et al. |
| 7,392,379 B2 | 6/2008 | Le Pennec et al. |
| 7,405,347 B2 | 7/2008 | Hammer et al. |
| 7,406,981 B2 | 8/2008 | Hemo et al. |
| 7,462,379 B2 | 12/2008 | Fukuda et al. |
| 7,485,777 B2 | 2/2009 | Nakajima et al. |
| 7,525,013 B2 | 4/2009 | Hildebrand et al. |
| 7,550,578 B2 | 6/2009 | Budworth et al. |
| 7,622,301 B2 | 11/2009 | Ren et al. |
| 7,657,299 B2 | 2/2010 | Huizenga et al. |
| 7,671,254 B2 | 3/2010 | Tranel et al. |
| 7,714,188 B2 | 5/2010 | Castle et al. |
| 7,738,626 B2 | 6/2010 | Weese et al. |
| 7,807,791 B2 | 10/2010 | Sekar et al. |
| 7,838,263 B2 | 11/2010 | Dam et al. |
| 7,838,733 B2 | 11/2010 | Wright et al. |
| 7,842,856 B2 | 11/2010 | Tranel et al. |
| 7,884,262 B2 | 2/2011 | Clemente et al. |
| 7,910,805 B2 | 3/2011 | Duck et al. |
| 7,935,869 B2 | 5/2011 | Pallett et al. |
| 7,943,819 B2 | 5/2011 | Baum et al. |
| 7,973,218 B2 | 7/2011 | McCutchen et al. |
| 8,090,164 B2 | 1/2012 | Bullitt et al. |
| 8,143,480 B2 | 3/2012 | Axtell et al. |
| 8,548,778 B1 | 10/2013 | Hart et al. |
| 8,554,490 B2 | 10/2013 | Tang et al. |
| 2001/0042257 A1 | 11/2001 | Connor-Ward et al. |
| 2002/0114784 A1 | 8/2002 | Li et al. |
| 2003/0150017 A1 | 8/2003 | Mesa et al. |
| 2003/0154508 A1 | 8/2003 | Stevens et al. |
| 2003/0167537 A1 | 9/2003 | Jiang |
| 2004/0053289 A1 | 3/2004 | Christian et al. |
| 2004/0055041 A1 | 3/2004 | Labate et al. |
| 2004/0072692 A1 | 4/2004 | Hoffmann et al. |
| 2004/0082475 A1 | 4/2004 | Hoffman et al. |
| 2004/0123347 A1 | 6/2004 | Hinchey et al. |
| 2004/0126845 A1 | 7/2004 | Eenennaam et al. |
| 2004/0133944 A1 | 7/2004 | Hake et al. |
| 2004/0147475 A1 | 7/2004 | Li et al. |
| 2004/0177399 A1 | 9/2004 | Hammer et al. |
| 2004/0216189 A1 | 10/2004 | Houmard et al. |
| 2004/0244075 A1 | 12/2004 | Cai et al. |
| 2005/0005319 A1 | 1/2005 | della-Cioppa et al. |
| 2005/0215435 A1 | 9/2005 | Menges et al. |
| 2006/0009358 A1 | 1/2006 | Kibler et al. |
| 2006/0021087 A1 | 1/2006 | Baum et al. |
| 2006/0111241 A1 | 5/2006 | Gerwick, III et al. |
| 2006/0130172 A1 | 6/2006 | Whaley et al. |
| 2006/0135758 A1 | 6/2006 | Wu |
| 2006/0200878 A1 | 9/2006 | Lutfiyya et al. |
| 2006/0223708 A1 | 10/2006 | Hoffmann et al. |
| 2006/0223709 A1 | 10/2006 | Helmke et al. |
| 2006/0247197 A1 | 11/2006 | Van De Craen et al. |
| 2006/0272049 A1 | 11/2006 | Waterhouse et al. |
| 2006/0276339 A1 | 12/2006 | Windsor et al. |
| 2007/0011775 A1 | 1/2007 | Allen et al. |
| 2007/0050863 A1 | 3/2007 | Tranel et al. |
| 2007/0124836 A1 | 5/2007 | Baum et al. |
| 2007/0199095 A1 | 8/2007 | Allen et al. |
| 2007/0250947 A1 | 10/2007 | Boukharov et al. |
| 2007/0259785 A1 | 11/2007 | Heck et al. |
| 2007/0281900 A1 | 12/2007 | Cui et al. |
| 2007/0300329 A1 | 12/2007 | Allen et al. |
| 2008/0022423 A1 | 1/2008 | Roberts et al. |
| 2008/0050342 A1 | 2/2008 | Fire et al. |
| 2008/0092256 A1 | 4/2008 | Kohn |
| 2008/0155716 A1 | 6/2008 | Sonnewald et al. |
| 2008/0214443 A1 | 9/2008 | Baum et al. |
| 2009/0011934 A1 | 1/2009 | Zawierucha et al. |
| 2009/0018016 A1 | 1/2009 | Duck et al. |
| 2009/0036311 A1 | 2/2009 | Witschel et al. |
| 2009/0054240 A1 | 2/2009 | Witschel et al. |
| 2009/0098614 A1 | 4/2009 | Zamore et al. |
| 2009/0118214 A1 | 5/2009 | Paldi et al. |
| 2009/0137395 A1 | 5/2009 | Chicoine et al. |
| 2009/0165153 A1 | 6/2009 | Wang et al. |
| 2009/0165166 A1 | 6/2009 | Feng et al. |
| 2009/0205079 A1 | 8/2009 | Kumar et al. |
| 2009/0215628 A1 | 8/2009 | Witschel et al. |
| 2009/0293148 A1 | 11/2009 | Ren et al. |
| 2009/0298787 A1 | 12/2009 | Raemaekers et al. |
| 2009/0307803 A1 | 12/2009 | Baum et al. |
| 2010/0005551 A1 | 1/2010 | Roberts et al. |
| 2010/0068172 A1 | 3/2010 | Van De Craen |
| 2010/0071088 A1 | 3/2010 | Sela et al. |
| 2010/0099561 A1 | 4/2010 | Selby et al. |
| 2010/0100988 A1 | 4/2010 | Tranel et al. |
| 2010/0152443 A1 | 6/2010 | Hirai et al. |
| 2010/0154083 A1 | 6/2010 | Ross et al. |
| 2010/0247578 A1 | 9/2010 | Salama |
| 2011/0015084 A1 | 1/2011 | Christian et al. |
| 2011/0015284 A1 | 1/2011 | Dees et al. |
| 2011/0028412 A1 | 2/2011 | Cappello et al. |
| 2011/0035836 A1 * | 2/2011 | Eudes et al. .................. 800/278 |
| 2011/0053226 A1 | 3/2011 | Rohayem |
| 2011/0098180 A1 | 4/2011 | Michel et al. |
| 2011/0105327 A1 | 5/2011 | Nelson |
| 2011/0105329 A1 | 5/2011 | Song et al. |
| 2011/0112570 A1 | 5/2011 | Mannava et al. |
| 2011/0126310 A1 | 5/2011 | Feng et al. |
| 2011/0126311 A1 | 5/2011 | Velcheva et al. |
| 2011/0152339 A1 | 6/2011 | Brown et al. |
| 2011/0152346 A1 | 6/2011 | Karleson et al. |
| 2011/0152353 A1 | 6/2011 | Koizumi et al. |
| 2011/0160082 A1 | 6/2011 | Woo et al. |
| 2011/0166022 A1 | 7/2011 | Israels et al. |
| 2011/0166023 A1 | 7/2011 | Nettleton-Hammond et al. |
| 2011/0171176 A1 | 7/2011 | Baas et al. |
| 2011/0171287 A1 | 7/2011 | Saarma et al. |
| 2011/0177949 A1 | 7/2011 | Krapp et al. |
| 2011/0185444 A1 | 7/2011 | Li et al. |
| 2011/0185445 A1 | 7/2011 | Bogner et al. |
| 2011/0191897 A1 | 8/2011 | Poree et al. |
| 2011/0201501 A1 | 8/2011 | Song et al. |
| 2011/0296555 A1 | 12/2011 | Ivashuta et al. |
| 2011/0296556 A1 | 12/2011 | Sammons et al. |
| 2012/0036594 A1 | 2/2012 | Cardoza et al. |
| 2012/0107355 A1 | 5/2012 | Harris et al. |
| 2012/0108497 A1 | 5/2012 | Paldi et al. |
| 2012/0137387 A1 | 5/2012 | Baum et al. |
| 2012/0150048 A1 | 6/2012 | Kang et al. |
| 2012/0156784 A1 | 6/2012 | Adams, Jr. et al. |
| 2012/0164205 A1 | 6/2012 | Baum et al. |
| 2012/0185967 A1 | 7/2012 | Sela et al. |
| 2012/0230565 A1 | 9/2012 | Steinberg et al. |
| 2012/0258646 A1 | 10/2012 | Sela et al. |
| 2013/0041004 A1 | 2/2013 | Drager et al. |
| 2013/0047297 A1 | 2/2013 | Sammons et al. |
| 2013/0060133 A1 | 3/2013 | Kassab et al. |
| 2013/0067618 A1 | 3/2013 | Ader et al. |
| 2013/0084243 A1 | 4/2013 | Goetsch et al. |
| 2013/0096073 A1 | 4/2013 | Sidelman |
| 2013/0097726 A1 | 4/2013 | Ader et al. |
| 2013/0212739 A1 | 8/2013 | Giritch et al. |
| 2013/0226003 A1 | 8/2013 | Edic et al. |
| 2013/0254940 A1 | 9/2013 | Ader et al. |
| 2013/0254941 A1 | 9/2013 | Ader et al. |
| 2013/0288895 A1 | 10/2013 | Ader et al. |
| 2013/0318657 A1 | 11/2013 | Avniel et al. |
| 2013/0318658 A1 | 11/2013 | Ader et al. |
| 2013/0324842 A1 | 12/2013 | Mittal et al. |
| 2013/0326731 A1 | 12/2013 | Ader et al. |
| 2014/0018241 A1 | 1/2014 | Sammons et al. |
| 2014/0057789 A1 | 2/2014 | Sammons et al. |
| 2014/0109258 A1 | 4/2014 | Van De Craen et al. |
| 2014/0230090 A1 | 8/2014 | Avniel et al. |
| 2014/0274712 A1 | 9/2014 | Finnessy et al. |
| 2014/0296503 A1 | 10/2014 | Avniel et al. |

FOREIGN PATENT DOCUMENTS

| | | | |
|---|---|---|---|
| CN | 201010248213 | * 12/2010 | ............... A01H 5/00 |
| DE | 10000600 A1 | 7/2001 | |

(56) References Cited

FOREIGN PATENT DOCUMENTS

| | | |
|---|---|---|
| DE | 10116399 A1 | 10/2002 |
| DE | 10256353 A1 | 6/2003 |
| DE | 10256354 A1 | 6/2003 |
| DE | 10256367 A1 | 6/2003 |
| DE | 10204951 A1 | 8/2003 |
| DE | 10234875 A1 | 2/2004 |
| DE | 10234876 A1 | 2/2004 |
| DE | 102004054666 A1 | 5/2006 |
| DE | 102005014638 A1 | 10/2006 |
| DE | 102005014906 A1 | 10/2006 |
| DE | 102007012168 A1 | 9/2008 |
| DE | 102010042866 A1 | 5/2011 |
| EP | 0 804 600 A1 | 11/1997 |
| EP | 1 157 991 A2 | 11/2001 |
| EP | 1 238 586 A1 | 9/2002 |
| EP | 1 416 049 A1 | 5/2004 |
| EP | 2 147 919 A1 | 1/2010 |
| EP | 2 160 098 B1 | 11/2010 |
| EP | 2 530 159 A1 | 3/2011 |
| EP | 2 305 813 A2 | 4/2011 |
| EP | 2 545 182 A1 | 1/2013 |
| JP | 2001253874 A | 9/2001 |
| JP | 2002080454 A | 3/2002 |
| JP | 2002138075 A | 5/2002 |
| JP | 2002145707 A | 5/2002 |
| JP | 2002220389 A | 8/2002 |
| JP | 2003064059 A | 3/2003 |
| JP | 2003096059 A | 4/2003 |
| JP | 2004051628 A | 2/2004 |
| JP | 2004107228 A | 4/2004 |
| JP | 2005008583 A | 1/2005 |
| JP | 2005239675 A | 9/2005 |
| JP | 2005314407 A | 11/2005 |
| JP | 2006232824 A | 9/2006 |
| JP | 2006282552 A | 10/2006 |
| JP | 2007153847 A | 6/2007 |
| JP | 2007161701 A | 6/2007 |
| JP | 2007182404 A | 7/2007 |
| JP | 2008074840 A | 4/2008 |
| JP | 2008074841 A | 4/2008 |
| JP | 2008133207 A | 6/2008 |
| JP | 2008133218 A | 6/2008 |
| JP | 2008169121 A | 7/2008 |
| JP | 2009067739 A | 4/2009 |
| JP | 2009114128 A | 5/2009 |
| JP | 2009126792 A | 6/2009 |
| JP | 2009137851 A | 6/2009 |
| WO | WO 89/11789 A1 | 12/1989 |
| WO | WO 95/34659 A1 | 12/1995 |
| WO | WO 95/34668 A2 | 12/1995 |
| WO | WO 96/05721 A1 | 2/1996 |
| WO | WO 96/33270 A1 | 10/1996 |
| WO | WO 96/38567 A2 | 12/1996 |
| WO | WO 96/40964 A2 | 12/1996 |
| WO | WO 99/24585 A1 | 5/1999 |
| WO | WO 99/26467 A1 | 6/1999 |
| WO | WO 99/27116 A2 | 6/1999 |
| WO | WO 99/32619 A1 | 7/1999 |
| WO | WO 99/61631 A1 | 12/1999 |
| WO | WO 99/67367 A1 | 12/1999 |
| WO | WO 00/32757 A2 | 6/2000 |
| WO | WO 00/44914 A1 | 8/2000 |
| WO | WO 02/14472 A2 | 2/2002 |
| WO | WO 02/066660 A2 | 8/2002 |
| WO | WO 03/000679 A2 | 1/2003 |
| WO | WO 03/006422 A1 | 1/2003 |
| WO | WO 03/013247 A1 | 2/2003 |
| WO | WO 03/016308 A1 | 2/2003 |
| WO | WO 03/020704 A1 | 3/2003 |
| WO | WO 03/022051 A1 | 3/2003 |
| WO | WO 03/022831 A1 | 3/2003 |
| WO | WO 03/022843 A1 | 3/2003 |
| WO | WO 03/029243 A2 | 4/2003 |
| WO | WO 03/037085 A1 | 5/2003 |
| WO | WO 03/037878 A1 | 5/2003 |
| WO | WO 03/045878 A2 | 6/2003 |
| WO | WO 03/050087 A2 | 6/2003 |
| WO | WO 03/051823 A1 | 6/2003 |
| WO | WO 03/051824 A1 | 6/2003 |
| WO | WO 03/051846 A2 | 6/2003 |
| WO | WO 03/076409 A1 | 9/2003 |
| WO | WO 03/077648 A2 | 9/2003 |
| WO | WO 03/087067 A1 | 10/2003 |
| WO | WO 03/090539 A1 | 11/2003 |
| WO | WO 03/091217 A1 | 11/2003 |
| WO | WO 03/093269 A1 | 11/2003 |
| WO | WO 03/104206 A2 | 12/2003 |
| WO | WO 2004/002947 A1 | 1/2004 |
| WO | WO 2004/002981 A2 | 1/2004 |
| WO | WO 2004/005485 A2 | 1/2004 |
| WO | WO 2004/009761 A2 | 1/2004 |
| WO | WO 2004/011429 A1 | 2/2004 |
| WO | WO 2004/022771 A2 | 3/2004 |
| WO | WO 2004/029060 A1 | 4/2004 |
| WO | WO 2004/035545 A2 | 4/2004 |
| WO | WO 2004/035563 A1 | 4/2004 |
| WO | WO 2004/035564 A1 | 4/2004 |
| WO | WO 2004/037787 A1 | 5/2004 |
| WO | WO 2004/049806 A1 | 6/2004 |
| WO | WO 2004/062351 A2 | 7/2004 |
| WO | WO 2004/067518 A1 | 8/2004 |
| WO | WO 2004/067527 A1 | 8/2004 |
| WO | WO 2004/074443 A2 | 9/2004 |
| WO | WO 2004/077950 A1 | 9/2004 |
| WO | WO 2005/000824 A1 | 1/2005 |
| WO | WO 2005/003362 A2 | 1/2005 |
| WO | WO 2005/007627 A1 | 1/2005 |
| WO | WO 2005/040152 A1 | 5/2005 |
| WO | WO 2005/047233 A1 | 5/2005 |
| WO | WO 2005/047281 A1 | 5/2005 |
| WO | WO 2005/061443 A2 | 7/2005 |
| WO | WO 2005/061464 A1 | 7/2005 |
| WO | WO 2005/068434 A1 | 7/2005 |
| WO | WO 2005/070889 A1 | 8/2005 |
| WO | WO 2005/089551 A1 | 9/2005 |
| WO | WO 2005/095335 A1 | 10/2005 |
| WO | WO 2005/107437 A2 | 11/2005 |
| WO | WO 2005/110068 A2 | 11/2005 |
| WO | WO 2006/006569 A1 | 1/2006 |
| WO | WO 2006/024820 A1 | 3/2006 |
| WO | WO 2006/029828 A1 | 3/2006 |
| WO | WO 2006/029829 A1 | 3/2006 |
| WO | WO 2006/037945 A1 | 4/2006 |
| WO | WO 2006/050803 A1 | 5/2006 |
| WO | WO 2006/074400 A2 | 7/2006 |
| WO | WO 2006/090792 A1 | 8/2006 |
| WO | WO 2006/123088 A2 | 11/2006 |
| WO | WO 2006/125687 A1 | 11/2006 |
| WO | WO 2006/125688 A1 | 11/2006 |
| WO | WO 2006/138638 A1 | 12/2006 |
| WO | WO 2007/003294 A1 | 1/2007 |
| WO | WO 2007/007316 A1 | 1/2007 |
| WO | WO 2007/024783 | 3/2007 |
| WO | WO 2007/026834 A1 | 3/2007 |
| WO | WO 2007/035650 A2 | 3/2007 |
| WO | WO 2007/039454 A1 | 4/2007 |
| WO | WO 2007/070389 A2 | 6/2007 |
| WO | WO 2007/071900 A1 | 6/2007 |
| WO | WO 2007/074405 A2 | 7/2007 |
| WO | WO 2007/077201 A1 | 7/2007 |
| WO | WO 2007/077247 A1 | 7/2007 |
| WO | WO 2007/080126 A1 | 7/2007 |
| WO | WO 2007/080127 A2 | 7/2007 |
| WO | WO 2007/096576 A1 | 8/2007 |
| WO | WO 2007/051462 A2 | 10/2007 |
| WO | WO 2007/119434 A1 | 10/2007 |
| WO | WO 2007/134984 A1 | 11/2007 |
| WO | WO 2008/007100 A2 | 1/2008 |
| WO | WO 2008/009908 A1 | 1/2008 |
| WO | WO 2008/029084 A1 | 3/2008 |
| WO | WO 2008/042231 A2 | 4/2008 |
| WO | WO 2008/059948 A1 | 5/2008 |
| WO | WO 2008/063203 A2 | 5/2008 |
| WO | WO 2008/071918 A1 | 6/2008 |

(56) References Cited

FOREIGN PATENT DOCUMENTS

| | | |
|---|---|---|
| WO | WO 2008/074991 A1 | 6/2008 |
| WO | WO 2008/084073 A1 | 7/2008 |
| WO | WO 2008/100426 A2 | 8/2008 |
| WO | WO 2008/102908 A1 | 8/2008 |
| WO | WO 2008/148223 A1 | 12/2008 |
| WO | WO 2008/152072 A2 | 12/2008 |
| WO | WO 2008/152073 A2 | 12/2008 |
| WO | WO 2009/000757 A1 | 12/2008 |
| WO | WO 2009/005297 A2 | 1/2009 |
| WO | WO 2009/035150 A2 | 3/2009 |
| WO | WO 2009/046384 A1 | 4/2009 |
| WO | WO 2009/063180 A1 | 5/2009 |
| WO | WO 2009/068170 A2 | 6/2009 |
| WO | WO 2009/068171 A2 | 6/2009 |
| WO | WO 2009/086041 A1 | 7/2009 |
| WO | WO 2009/090401 A2 | 7/2009 |
| WO | WO 2009/090402 A2 | 7/2009 |
| WO | WO 2009/115788 A1 | 9/2009 |
| WO | WO 2009/116558 A1 | 9/2009 |
| WO | WO 2009/125401 A2 | 10/2009 |
| WO | WO 2009/152995 A1 | 12/2009 |
| WO | WO 2009/158258 A1 | 12/2009 |
| WO | WO 2010/012649 A1 | 2/2010 |
| WO | WO 2010/026989 A1 | 3/2010 |
| WO | WO 2010/034153 A1 | 4/2010 |
| WO | WO 2010/049270 A1 | 5/2010 |
| WO | WO 2010/049369 A1 | 5/2010 |
| WO | WO 2010/049405 A1 | 5/2010 |
| WO | WO 2010/049414 A1 | 5/2010 |
| WO | WO 2010/063422 A1 | 6/2010 |
| WO | WO 2010/069802 A1 | 6/2010 |
| WO | WO 2010/078906 A2 | 7/2010 |
| WO | WO 2010/078912 A1 | 7/2010 |
| WO | WO 2010/104217 A1 | 9/2010 |
| WO | WO 2010/108611 A1 | 9/2010 |
| WO | WO 2010/112826 A2 | 10/2010 |
| WO | WO 2010/116122 A2 | 10/2010 |
| WO | WO 2010/119906 A1 | 10/2010 |
| WO | WO 2010/130970 A1 | 11/2010 |
| WO | WO 2011/001434 A1 | 1/2011 |
| WO | WO 2011/003776 A2 | 1/2011 |
| WO | WO 2011/035874 A1 | 3/2011 |
| WO | WO 2011/045796 A1 | 4/2011 |
| WO | WO 2011/065451 A1 | 6/2011 |
| WO | WO 2011/067745 A2 | 6/2011 |
| WO | WO 2011/080674 A2 | 7/2011 |
| WO | WO 2011/112570 A1 | 9/2011 |
| WO | WO 2011/132127 A1 | 10/2011 |
| WO | WO 2012/001626 A1 | 1/2012 |
| WO | WO 2012/056401 A1 | 5/2012 |
| WO | WO 2012/092580 A2 | 7/2012 |
| WO | WO 2013/010691 A1 | 1/2013 |
| WO | WO 2013/025670 A1 | 2/2013 |
| WO | WO 2013/039990 A1 | 3/2013 |
| WO | WO 2013/040005 A1 | 3/2013 |
| WO | WO 2013/040021 A1 | 3/2013 |
| WO | WO 2013/040033 A1 | 3/2013 |
| WO | WO 2013/040057 A1 | 3/2013 |
| WO | WO 2013/040116 A9 | 3/2013 |
| WO | WO 2013/040117 A9 | 3/2013 |
| WO | WO 2013/153553 A2 | 10/2013 |
| WO | WO 2013/175480 A1 | 11/2013 |
| WO | WO 2014/106837 A2 | 7/2014 |
| WO | WO 2014/106838 A2 | 7/2014 |
| WO | WO 2014/151255 A1 | 9/2014 |
| WO | WO 2014/164761 A1 | 10/2014 |
| WO | WO 2014/164797 A1 | 10/2014 |
| WO | WO 2015/010026 A2 | 1/2015 |

OTHER PUBLICATIONS

Lein, Wolfgang, et al. "Target-based discovery of novel herbicides." Current opinion in plant biology 7.2 (2004): 219-225.*

"Tank Mixing Chemicals Applied to Peanut Crops", published online on Jul. 31, 2004 at www.peanut.ncsu.edu/pdffiles/004993/tank_mixing_chemicals_applied_to_peanut_crops.pdf.*

Riggins, Chance W., et al. "Characterization of de novo transcriptome for waterhemp (*Amaranthus tuberculatus*) using GS-FLX 454 pyrosequencing and its application for studies of herbicide target-site genes." Pest management science 66.10 (2010): 1042-1052.*

Alarcón-Reverte et al., "Resistance to ACCase-inhibiting herbicides in the weed *Lolium multiflorum*," *Comm. Appl. Biol. Sci.*, 73(4):899-902 (2008).

Amarzguioui et al., "An algorithm for selection of functional siRNA sequences," *Biochemical and Biophysical Research Communications*, 316:1050-1058 (2004).

Ambrus et al., "The Diverse Roles of RNA Helicases in RNAi," *Cell Cycle*, 8(21):3500-3505 (2009).

An et al., "Transient RNAi Induction against Endogenous Genes in Arabidopsis Protoplasts Using in Vitro-Prepared Double-Stranded RNA," *Biosci Biotechnol Biochem*, 69(2):415-418 (2005).

Andersson et al., "A novel selection system for potato transformation using a mutated AHAS gene," *Plant Cell Reports*, 22(4):261-267 (2003).

Anonymous, "A handbook for high-level expression and purification of 6xHis-tagged proteins," *The QUIexpressionist*, (2003).

Anonymous, "Agronomy Facts 37: Adjuvants for enhancing herbicide performance," n.p., 1-8, (Jan. 26, 2000), Web, (Jan. 21, 2014).

Anonymous, "Devgen, The mini-Monsanto," KBC Securities (2006).

Anonymous, "Do Monsanto have the next big thing?," *Australian Herbicide Resistance Initiative (AHRI)*, (Apr. 23, 2013) Web. (Jan. 19, 2015).

Aoki et al., "In Vivo Transfer Efficiency of Antisense Oligonucleotides into the Myocardium Using HVJ—Liposome Method," *Biochem Biophys Res Commun*, 231:540-545 (1997).

Arpaia et al., "Production of transgenic eggplant (*Solanum melongena* L.) resistant to Colorado Potato Beetle (*Leptinotarsa decemlineata* Say)," (1997) *Theor. Appl. Genet.*, 95:329-334 (1997).

Artmymovich, "Using RNA interference to increase crop yield and decrease pest damage," *MMG 445 Basic Biotech.*, 5(1):7-12 (2009).

Australian Patent Examination report No. 1 issued Nov. 11, 2013, in Australian Application No. 2011224570.

Axtell et al., "A Two-Hit Trigger for siRNA Biogenesis in Plants," *Cell*, 127:565-577 (2006).

Baerson et al., "Glyphosate-Resistant Goosegrass. Identification of a Mutation in the Target Enzyme 5-Enolpyruvylshikimate-3-Phosphate Synthase," *Plant Physiol.*, 129(3):1265-1275 (2002).

Bannerjee et al., "Efficient production of transgenic potato (*S. tuberosum* L. ssp. *andigena*) plants via *Agrobacterium tumefaciens*-mediated transformation," *Plant Sci.*, 170:732 738 (2006).

Baulcombe, "RNA silencing and heritable epigenetic effects in tomato and Arabidopsis," Abstract 13th Annual Fall Symposium, Plant Genomes to Phenomes, Donald Danforth Plant Science Center, 28-30 (2011).

Bayer et al., "Programmable ligand-controlled riboregulators of eukaryotic gene expression," *Nature Biotechnol.*, 23(3):337-343 (2005).

Beal, et al., "Second Structural Motif for Recognition of DNA by Oligonucleotide-Directed Triple-Helix Formation," *Science*, 251:1360-1363 (1992).

Becker et al., "Fertile transgenic wheat from microprojectile bombardment of scutellar tissue," *The Plant Journal*, 5(2):299-307 (1994).

Bhargava et al., "Long double-stranded RNA-mediated RNA interference as a tool to achieve site-specific silencing of hypothalamic neuropeptides," *Brain Research Protocols*, 13:115-125 (2004).

Boletta et al., "High Efficient Non-Viral Gene Delivery to the Rat Kidney by Novel Polycationic Vectors," *J Am Soc. Nephrol.*, 7:1728 (1996).

Bolognesi et al., "Characterizing the Mechanism of Action of Double-Stranded RNA Activity against Western Corn Rootworm(*Diabrotica virgifera virgifera* LeConte)," PLoS ONE 7(10):e47534 (2012).

(56) References Cited

OTHER PUBLICATIONS

Bolter et al., "A chloroplastic inner envelope membrane protease is essential for plant development," *FEBS Letters*, 580:789-794 (2006).
Breaker et al., "A DNA enzyme with $Mg^{2+}$-dependent RNA phosphoesterase activity," *Chemistry and Biology*, 2:655-660 (1995).
Brodersen et al., "The diversity of RNA silencing pathways in plants," *Trends in Genetics*, 22(5):268-280 (2006).
Busi et al., "Gene flow increases the initial frequency of herbicide resistance alleles in unselectedpopulations," *Agriculture, Ecosystems and Environments*, Elsevier, Amsterdam, NL, 142(3):403-409 (2011).
Butler et al., "Priming and re-drying improve the survival of mature seeds of *Digitalis purpurea* during storage," *Annals of Botany*, 103:1261-1270 (2009).
Bytebier et al., "T-DNA organization in tumor cultures and transgenic plants of the monocotyledon *Asparagus officinalis,*" *Proc. Natl. Acad. Sci. U.S.A.*, 84:5345-5349 (1987).
Chabbouh et al., "Cucumber mosaic virus in artichoke," *FAO Plant Protection Bulletin*, 38:52-53 (1990).
Chakravarty et al., "Genetic Transformation in Potato: Approaches and Strategies," *Amer J Potato Res*, 84:301 311 (2007).
Chee et al., "Transformation of Soybean (*Glycine max*) by Infecting Germinating Seeds with *Agrobacterium tumefaciens,*" *Plant Physiol.*, 91:1212-1218 (1989).
Chen et al., "In Vivo Analysis of the Role of atTic20 in Protein Import into Chloroplasts," *The Plant Cell*, 14:641-654 (2002).
Cheng et al., "Production of fertile transgenic peanut (*Arachis hypogaea L.*) plants using *Agrobacterium tumefaciens,*" *Plant Cell Reports*, 15:653-657 (1996).
Chi et al., "The Function of RH22, a DEAD RNA Helicase, in the Biogenesis of the 50S Ribosomal Subunits of Arabidopsis Chloroplasts," *Plant Physiology*, 158:693-707 (2012).
Chinese Office Action issued Aug. 28, 2013 in Chinese Application No. 201180012795.2.
Clough et al., "Floral dip: a simplified method for Agrobacterium-mediated transformation of *Arabidopsis thaliana,*" *The Plant Journal*, 16(6):735-743 (1998).
CN101914540 Patent Diclosure, "Introduction of RNA into plant by interference," (2010).
Colbourne et al., "The Ecoresponsive Genome of Daphnia pulex," *Science*, 331(6017):555-561 (2011).
Colombian Office Action issued Aug. 2, 2013 in Application No. 12 152898.
Colombian Office Action issued Feb. 21, 2014 in Application No. 12 152898.
Cooney et al., "Site-Specific Oligonucleotide Binding Represses Transcription of the Human c-myc Gene in Vitro," *Science*,241:456-459 (1988).
Cost Action FA0806 progress report "Plant virus control employing RNA-based vaccines: A novel non-transgenic strategy" (2010).
Coticchia et al., "Calmodulin modulates Akt activity in human breast cancer cell lines," *Breast Cancer Res. Treat*, 115:545-560 (2009).
Dalmay et al., "An RNA-Depenedent RNA Polymerase Gene in *Arabidopsis* Is Required for Posttranscriptional Gene Silencing Mediated by a Transgene but Not by a Virus," *Cell*, 101:543-553 (2000).
Database EMBL CBIB Daphnia-XP-002732239 (2011).
Davidson et al., "Engineering regulatory RNAs," *Trends in Biotechnology*, 23(3):109-112 (2005).
De Block, et al. "Engineering herbicide resistance in plants by expression of a detoxifying enzyme," *EMBO J.* 6(9):2513-2519 (1987).
De Framond, "MINI-Ti: A New Vector Strategy for Plant Genetic Engineering," *Nature Biotechnology*, 1:262-269 (1983).
della-Cioppa et al., "Import of a precursor protein into chloroplasts is inhibited by the herbicide glyphosate," *The EMBO Journal*, 7(5):1299-1305 (1988).

Diallo et al., "Long Endogenous dsRNAs Can Induce Complete Gene Silencing in Mammalian Cells and Primary Cultures," *Oligonucleotides*, 13:381-392 (2003).
Dietemann et al., "*Varroa destructor*: research avenues towards sustainable control," *Journal of Apicultural Research*, 51(1):125-132 (2012).
Du et al., "A systematic analysis of the silencing effects of an active siRNA at all single-nucleotide mismatched target sites," *Nucleic Acids Research*, 33(5):1671-1677 (2005).
Dunoyer et al., "Small RNA Duplexes Function as Mobile Silencing Signals Between Plant Cells," *Science*, 328:912-916 (2010).
Ellington et al., "In vitro selection of RNA molecules that bind specific ligands," *Nature*, 346:818-822 (1990).
Eurasian Office Action issued Feb. 24, 2014, in Application No. 201201264.
European Cooperation in the field of Scientific and Technical Research—Memorandum of Understanding for COST Action FA0806 (2008).
European Supplemental Search Report issued Oct. 8, 2013 in Application No. 11753916.3.
Extended European Search Report dated Jan. 21, 2015, in European Patent Application No. 12 832 415.9.
Extended European Search Report dated Jan. 29, 2015, in European Patent Application No. 12 831 567.8.
Extended European Search Report dated Feb. 2, 2015, in European Patent Application No. 12 830 932.5.
Extended European Search Report dated Feb. 3, 2015, in European Patent Application No. 12 831 945.6.
Extended European Search Report dated Feb. 27, 2015, in European Patent Application No. 12 832 160.1.
Extended European Search Report dated Mar. 3, 2015, in European Patent Application No. 12 831 166.9.
Extended European Search Report dated Mar. 17, 2015, in European Patent Application No. 12 831 684.1.
Partial Supplementary European Search Report dated Mar. 2, 2015, in European Patent Application No. 12 831 494.5.
Farooq et al., "Rice seed priming," *IPRN*, 30(2):45-48 (2005).
Fire et al., "Potent and specific genetic interference by double-stranded RNA in *Caenorhabditis elegans,*" *Nature*, 391:806-811 (1998).
First Examination Report issued on Apr. 23, 2013, in New Zealand Patent Application No. 601784.
First Examination Report issued on Jul. 28, 2014, in New Zealand Patent Application No. 627060.
Fukuhara et al., "Enigmatic Double-Stranded RNA in Japonica Rice," *Plant Molecular Biology*, 21:1121-1130 (1993).
Fukuhara et al., "The Unusual Structure of a Novel RNA Replicon in Rice," *The Journal of Biological Chemistry*, 270(30):18147-18149 (1995).
Fukuhara et al., "The wide distribution of endornaviruses, large double-stranded RNA replicons with plasmid-like properties," *Archives of Virology*, 151:995-1002 (2006).
Further Examination Report issued in New Zealand Patent Application No. 601784 on May 16, 2014.
Gaines et al., "Gene amplification confers glyphosate resistance in *Amaranthus palmeri,*" *Proc. Natl. Acad. Sci. USA*, 107(3):1029-1034 (2010).
Gallie et al., "Identification of the motifs within the tobacco mosaic virus 5'-leader responsible for enhancing translation," *Nucleic Acids Res.*, 20(17):4631-4638 (1992).
Gan et al., "Bacterially expressed dsRNA protects maize against SCMV infection," *Plant Cell Rep*, 11:1261-1268 (2010).
Gao et al., "Down-regulation of acetolactate synthase compromises 01-1-mediated resistance to powdery mildew in tomato," *BMC Plant Biology*, 14 (2014).
Garbian et al., "Bidirectional Transfer of RNAi between Honey Bee and *Varroa destructor*: *Varroa* Gene Silencing Reduces *Varroa* Population," 8(12):1-9:e1003035 (2012).
Ge et al., "Rapid vacuolar sequestration: the horseweed glyphosate resistance mechanism," *Pest Management Sci.*, 66:345-348 (2010).
GenBank Accession No. DY640489, PU2_plate27_F03 PU2 Prunus persica cDNA similar to expressed mRNA inferred from Prunus persica hypothetical domain/motif containing

(56) References Cited

OTHER PUBLICATIONS

IPR011005:Dihydropteroate synthase-like, MRNA sequence (2006) [Retrieved on Feb. 4, 2013]. Retrieved from the internet <URL: http://www.ncbi.nlm.nih.gov/nucest/DY640489>.
GenBank Accession No. EU24568—"Amaranthus hypochondriacus acetolactate synthase (ALS) gene," (2007).
GenBank Accession No. FJ972198, Solanum lycopersicum cultivar Ailsa Craig dihydropterin pyrophosphokinase-dihydropteroate synthase (HPPK-DHPS) gene, complete cds (2010) [Retrieved on Nov. 26, 2012]. Retrieved from the internet ,URL: http://www.ncbi.nlm.nih.gov/nuccore/FJ972198>.
GenBank accession No. AY545657.1, published 2004.
GenBank accession No. GI:186478573, published Jan. 22, 2014.
GenEmbl FJ861243, published Feb. 3, 2010.
Gong et al., "Silencing of Rieske iron-sulfur protein using chemically synthesised siRNA as a potential biopesticide against Plutella xylostella," *Pest Manag Sci*, 67:514-520 (2011).
Gressel et al., "A strategy to provide long-term control of weedy rice while mitigating herbicide resistance transgene flow, and its potential use for other crops with related weeds," *Pest Manag Sci*, 65(7):723-731 (2009).
Gutensohn et al., "Functional analysis of the two *Arabidopsis* homologues of Toc34, a component of the chloroplast protein import apparatus," *The Plant Journal*, 23(6):771-783 (2000).
Haigh, "The Priming of Seeds: Investigation into a method of priming large quantities of seeds using salt solutions," Thesis submitted to Macquarie University (1983).
Hamilton et al"Guidelines for the Identification and Characterization of Plant Viruses," *J. gen. Virol.*, 54:223-241 (1981).
Hamilton et al., "Two classes of short interfering RNA in RNA silencing," *EMBO J.*, 21(17):4671-4679 (2002).
Han et al., "Molecular Basis for the Recognition of Primary microRNAs by the Drosha-DGCR8 Complex," *Cell*, 125(5):887-901 (2006).
Hannon, "RNA interference," *Nature*,481:244-251 (2002).
Hardegree, "Drying and storage effects on germination of primed grass seeds," *Journal of Range Management*, 47(3):196-199 (1994).
Harrison et al., "Does Lowering Glutamine Synthetase Activity in Nodules Modigy Nitrogen Metabolism and Growth of *Lotus japonicus?,"* Plant Physiology*, 133:253-262 (2003).
Herman et al., "A three-component dicamba O-demethylase from *Pseudomonas maltophilia*, strain DI-6: gene isolation, characterization, and heterologous expression," *J. Biol. Chem.*, 280: 24759-24767 (2005).
Hewezi et al., "Local infiltration of high- and low-molecular-weight RNA from silenced sunflower (*Helianthus annuus* L.) plants triggers post-transcriptional gene silencing in non-silenced plants," *Plant Biotechnology Journal*, 3:81-89 (2005).
Hidayat et al., "Enhanced Metabolism of Fluazifop Acid in a Biotype of *Digitaria sanguinalis* Resistant to the Herbicide Fluazifop-P-Butyl," *Pesticide Biochem. Physiol.*, 57:137-146 (1997).
Himber et al., "Transitivity-dependant and -independent cell-to-cell movement of RNA silencing," *The EMBO Journal*, 22(17):4523-4533 (2003).
Hirschberg et al., "Molecular Basis of Herbicide Resistance in *Amaranthus hybridus,"* Science*, 222:1346-1349 (1983).
Hoekema et al., "A binary plant vector strategy based on separation of vir- and T-region of the *Agrobacterium tumefaciens* Ti-plasmid," *Nature*, 303:179-180 (1983).
Hofgen et al., "Repression of Acetolactate Synthase Activity through Antisense Inhibition: Molecular and Biochemical Analysis of Transgenic Potato (*Solanum tuberosum* L. cv Desiree) Plants," *Plant Physiol.*, 107(2):469-477 (1995).
Hsieh et al., "A library of siRNA duplexes targeting the phosphoinositide 3-kinase pathway: determinants of gene silencing for use in cell-based screens," *Nucleic Acids Res.*, 32(3):893-901 (2004).

Huesken et al., "Design of a genome-wide siRNA library using an artificial neural network," *Nature Biotechnology*, 23(8): 995-1001 (2005).
Hunter et al., "RNA Interference Strategy to suppress Psyllids & Leafhoppers," *International Plant and Animal Genome XIX*, 15-19 (2011).
Ichihara et al., "Thermodynamic instability of siRNA duplex is a prerequisite for dependable prediction of siRNA activities," *Nucleic Acids Res.*, 35(18):e123 (2007).
International Preliminary Report on Patentability issued on Sep. 11, 2014, in International Application No. PCT/IL13/50447.
International Search Report and the Written Opinion dated May 10, 2011, in International Application No. PCT/US 11/27528.
International Search Report and the Written Opinion dated Feb. 25, 2013, in International Application No. PCT/US 12/54883.
International Search Report and the Written Opinion dated Feb. 27, 2013, in International Application No. PCT/US 12/54814.
International Search Report and the Written Opinion dated Feb. 27, 2013, in International Application No. PCT/US 12/54842.
International Search Report and the Written Opinion dated Feb. 27, 2013, in International Application No. PCT/US 12/54862.
International Search Report and the Written Opinion dated Feb. 27, 2013, in International Application No. PCT/US 12/54894.
International Search Report and the Written Opinion dated Feb. 27, 2013, in International Application No. PCT/US 12/54974.
International Search Report and the Written Opinion dated Feb. 27, 2013, in International Application No. PCT/US 12/54980.
International Search Report and the Written Opinion dated Oct. 1, 2013, in International Application No. PCT/IL2013/050447.
International Search Report and the Written Opinion dated Jul. 15, 2014, in International Application No. PCT/US2014/025305.
International Search Report and the Written Opinion dated Jul. 22, 2014, in International Application No. PCT/IL2013/051083.
International Search Report and the Written Opinion dated Jul. 22, 2014, in International Application No. PCT/IL2013/051085.
International Search Report and the Written Opinion dated Jul. 24, 2014, in International Application No. PCT/US2014/026036.
International Search Report and Written Opinion dated Aug. 25, 2014, in International Application No. PCT/US2014/023503.
International Search Report and Written Opinion dated Aug. 27, 2014, in International Application No. PCT/US2014/023409.
International Search Report and Written Opinion dated Feb. 23, 2015, in International Application No. PCT/US2014/063832.
International Search Report dated Mar. 12, 2013, in International Application No. PCT/US 12/54789.
Invitation to Pay Additional Fees dated May 6, 2014, in International Application No. PCT/IL2013/051083.
Invitation to Pay Additional Fees dated May 6, 2014, in International Application No. PCT/IL2013/051085.
Invitation to Pay Additional Fees dated Nov. 25, 2014, in International Application No. PCT/US2014/047204.
Isaacs et al., "Engineered riboregulators enable post-transcriptional control of gene expression," *Nature Biotechnology*, 22(7):841-847 (2004).
Ji et al., "Regulation of small RNA stability: methylation and beyond," *Cell Research*, 22:624-636 (2012).
Jones-Rhoades et al., "MicroRNAs and Their Regulatory Roles in Plants," *Annu. Rev. Plant Biol.*, 57:19-53 (2006).
Josse et al., "A DELLA in Disguise: SPATULA Restrains the Growth of the Developing *Arabidopsis* Seedling," *Plant Cell*, 23:1337-1351 (2011).
Kam et al., "Nanotube Molecular Transporters: Internalization of Carbon Nanotube-Protein Conjugates into Mammalian Cells," *J Am. Chem. Soc.*, 126(22):6850-6851 (2004).
Katoh et al., "Specific residues at every third position of siRNA shape its efficient RNAi activity," *Nucleic Acids Res.*, 35(4): e27 (2007).
Kertbundit et al., "In vivo random β-glucuronidase gene fusions in *Arabidopsis thaliana,"* Proc. Natl. Acad. Sci. U S A.*, 88:5212-5216 (1991).
Khachigian, "DNAzymes: Cutting a path to a new class of therapeutics," *Curr Opin Mol Ther* 4(2):119-121 (2002).

(56) References Cited

OTHER PUBLICATIONS

Khodakovskaya et al., "Carbon Nanotubes Are Able to Penetrate Plant Seed Coat and Dramatically Affect Seed Germination and Plant Growth," *ACS Nano*, 3(10):3221-3227 (2009).
Kirkwood, "Use and Mode of Action of Adjuvants for Herbicides: A Review of some Current Work," *Pestic Sci.*, 38:93-102 (1993).
Klahre et al., "High molecular weight RNAs and small interfering RNAs induce systemic posttranscriptional gene silencing in plants," *Proc. Natl. Acad. Sci. USA*, PNAS, 99(18):11981-11986 (2002).
Kronenwett et al., "Oligodeoxyribonucleotide Uptake in Primary Human Hematopoietic Cells Is Enhanced by Cationic Lipids and Depends on the Hematopoietic Cell Subset," *Blood*, 91(3):852-862 (1998).
Kumar et al., "Sequencing, De Novo Assembly and Annotation of the Colorado Potato Beetle, *Leptinotarsa decemlineata*,Transcriptome," *PLoS One*, 9(1):e86012 (2014).
Kusaba et al., "*Low glutelin content1*: A Dominant Mutation That Suppresses the Glutelin Multigene Family via RNA Silencing ni Rice," *The Plant Cell*, 15(6):1455-1467 (2003).
Kusaba, "RNA interference in crop plants," *Curr Opin Biotechnol*, 15(2):139-143 (2004).
Lavigne et al., "Enhanced antisense inhibition of human immunodeficiency virus type 1 in cell cultures by DLS delivery system," *Biochem Biophys Res Commun*, 237:566-571 (1997).
Lee et al., "Aptamer Database," *Nucleic Acids Research*, 32:D95-D100 (2004).
Lermontova et al., "Reduced activity of plastid protoporphyrinogen oxidase causes attenuated photodynamic damage during high-light compared to low-light exposure," *The Plant Journal*, 48(4):499-510 (2006).
Lesnik et al., "Prediction of rho-independent transcriptional terminators in *Escherichia coli,*" *Nucleic Acids Research*, 29(17):3583-3594 (2001).
Li et al., "Establishment of a highly efficient Transformation system for pepper (*Capsicum amiuum* L.)," *Plant Cell Reports*, 21: 785-788 (2003).
Li et al., "The Fast technique: a simplified Agrobacterium-based transformation method for transient gene expression analysis in seedlings of *Arabidopsis* and other plant species," *Plant Methods*, 5(6):1-15 (2009).
Liu et al., "Carbon Nanotubes as Molecular Transporters for Walled Plant Cells," *Nano Letters*, 9(3):1007-1010 (2009).
Liu et al., "Comparative study on the interaction of DNA with three different kinds of surfactants and the formation of multilayer films," *Bioelectrochemistry*, 70:301-307 (2007).
Liu et al., "DNAzyme-mediated recovery of small recombinant RNAs from a 5S rRNA-derived chimera expressed in *Escherichia coli,*" *BMC Biotechnology*, 10:85 (2010).
Llave et al., "Endogenous and Silencing-Associated Small RNAs in Plants," *The Plant Cell*, 14:1605-1619 (2002).
Lu et al., "RNA silencing in plants by the expression of siRNA duplexes," *Nucleic Acids Res.*, 32(21):e171 (2004).
Lu et al., "OligoWalk: an online siRNA design tool utilizing hybridization thermodynamics," *Nucleic Acids Research*, 36:W104-W108 (2008).
Luft, "Making sense out of antisense oligodeoxynucleotide delivery: getting there is half the fun," *J Mol Med*, 76:75-76 (1998).
Maas et al., "Mechanism and optimized conditions for PEG mediated DNA transfection into plant protoplasts," *Plant Cell Reports*, 8:148-149 (1989).
Maher III et al. ,"Inhibition of DNA binding proteins by oligonucleotide-directed triple helix formation," *Science*, 245(4919):725-730 (1989).
Makkouk et al., "Virus Diseases of Peas, Beans, and Faba Bean in the Mediterranean region," *Adv Virus Res*, 84:367-402 (2012).
Mandal et al., "Adenine riboswitcbes and gene activation by disruption of a transcription terminator," *Nature Struct. Mol. Biol.*, 11(1):29-35 (2004).
Mandal et al., "Gene Regulation by Riboswitches," *Nature Reviews l Molecular Cell Biology*, 5:451-463 (2004).

Manoharan, "Oligonucleotide Conjugates as Potential Antisense Drugs with Improved Uptake, Biodistribution, Targeted Delivery, and Mechanism of Action," *Antisense & Nucleic Acid Drug Development*, 12:103-128 (2002).
Masoud et al., "Constitutive expression of an inducible β-1,3-glucanase in alfalfa reduces disease severity caused by the oomycete pathogen *Phytophthora megasperma* f. sp *medicaginis*, but does not reduce disease severity of chitincontaining fungi," *Transgenic Research*, 5:313-323 (1996).
Matveeva et al., "Prediction of antisense oligonucleotide efficacy by in vitro methods," *Nature Biotechnology*, 16:1374-1375 (1998).
Meinke, et al., "Identifying essential genes in *Arabidopsis thaliana,*" *Trends Plant Sci.*, 13(9):483-491 (2008).
Meins et al., "RNA Silencing Systems and Their Relevance to Plant Development," *Annu. Rev. Cell Dev. Biol.*, 21:297-318 (2005).
Melnyk et al., "Intercellular and systemic movement of RNA silencing signals," *The EMBO Journal*, 30:3553-3563 (2011).
Misawa et al., "Functional expression of the *Erwinia uredovora* carotenoid biosynthesis gene crtI in transgenic plants showing an increase of β-carotene biosynthesis activity and resistance to the bleaching herbicide norflurazon," *The Plant Journal*, 4(5):833-840 (1993).
Misawa et al., "Expression of an *Erwinia* phytoene desaturase gene not only confers multiple resistance to herbicides interfering with carotenoid biosynthesis but also alters xanthophyll metabolism in transgenic plants," *The Plant Journal*, 6(4):481-489 (1994).
Miura et al., "The Balance between Protein Synthesis and Degradation in Chloroplasts Determines Leaf Variegation in *Arabidopsis yellow variegated* Mutants," *The Plant Cell*, 19:1313-1328 (2007).
Molnar et al., "Plant Virus-Derived Small Interfering RNAs Originate redominantly from Highly Structured Single-Stranded Viral RNAs," *Journal of Virology*, 79(12):7812-7818 (2005).
Molnar et al., "Small Silencing RNAs in Plants Are Mobile and Direct Epigenetic Modification in Recipient Cells," *Science*, 328:872-875 (2010).
Moriyama et al., "Double-stranded RNA in rice: a novel RNA replicon in plants," *Molecular & General Genetics*, 248(3):364-369 (1995).
Moriyama et al., "Stringently and developmentally regulated levels of a cytoplasmic double-stranded RNA and its high-efficiency transmission via egg and pollen in rice," *Plant Molecular Biology*, 31:713-719 (1996).
Morrissey et al., "Potent and persistent in vivo anti-HBV activity of chemically modified siRNAs," *Nat Biotechnol.* 23(8):1002-1007 (2005).
Moser et al., "Sequence-Specific Cleavage of Double Helical DNA by Triple Helix Formation," *Science*, 238:645-646 (1987).
Nowak et al., "A new and efficient method for inhibition of RNA viruses by DNA interference," *The FEBS Journal*, 276:4372-4380 (2009).
Office Action dated Feb. 17, 2014, in Mexican Patent Application No. MX/a/2012/010479.
Office Action issued on Jan. 6, 2015, in Japanese Patent Application No. 2012-557165.
Office Action issued on Nov. 19, 2014, in Eurasian Patent Application No. 201201264/28.
Office Action issued on Nov. 3, 2014, in Chinese Patent Application No. 201180012795.2.
Ongvarrasopone et al., "A Simple and Cost Effective Method to Generate dsRNA for RNAi Studies in Invertebrates," *Science Asia*, 33:35-39 (2007).
Ouellet et al., "Members of the Acetohydroxyacid Synthase Muligene Family of Brassica Napus Have Divergent Patterns of Expression," *The Plant Journal*, Blackwell Scientific Publications, Oxford, GB, 2(3):321-330 (1992).
Paddison et al., "Stable suppression of gene expression by RNAi in mammalian cells," *Proc. Natl Acad. Sci. USA*, 99(3):1443-1448 (2002).
Palauqui et al., "Activation of systemic acquired silencing by localised introduction of DNA," *Current Biology*, 9:59-66 (1999).
Parera et al., "Dehydration Rate after Solid Matrix Priming Alters Seed Performance of Shrunken-2 Corn," *J. Amer. Soc. Hort. Sci.*, 119(3):629-635 (1994).

(56) References Cited

OTHER PUBLICATIONS

Paungfoo-Lonhienne et al., "DNA is Taken up by Root Hairs and Pollen, and Stimulates Root and Pollen Tube Growth," *Plant Physiology*, 153:799-805 (2010).
Paungfoo-Lonhienne et al., "DNA uptake by Arabidopsis induces changes in the expression of CLE peptides which control root morphology," *Plant Signaling & Behavior*, 5(9):1112-1114 (2010).
Pei et al., "On the art of identifying effective and specific siRNAs," *Nature Methods*, 3(9):670-676 (2006).
Peretz et al., "A Universal Expression/Silencing Vector in Plants," *Plant Physiology*, 145:1251-1263 (2007).
Pornprom et al., "Glutamine synthetase mutation conferring target-site-based resistance to glufosinate in soybean cell selections," *Pest Manag Sci*, 2009; 65(2):216-222 (2009).
Preston et al., "Multiple effects of a naturally occurring proline to threonine substitution within acetolactate synthase in two herbicide-resistant populations of *Lactuca serriola*," *Pesticide Biochem. Physiol.*, 84(3):227-235 (2006).
Qiwei, "Advance in DNA interference," *Progress in Veterinary Medicine*, 30(1):71-75 (2009).
Rajur et al., "Covalent Protein—Oligonucleotide Conjugates for Efficient Delivery of Antisense Molecules," *Bioconjug Chem.*, 8:935-940 (1997).
Reddy et al "Organosilicone Adjuvants Increased the Efficacy of Glyphosate for Control of Weeds in Citrus (Citrus spp.)" *HortScience* 27(9):1003-1005 (1992).
Reddy et al., "Aminomethylphosphonic Acid Accumulation in Plant Species Treated with Glyphosate," *J. Agric. Food Chem.*, 56(6):2125-2130 (2008).
Reither et al., "Specificity of DNA triple helix formation analyzed by a FRET assay," *BMC Biochemistry*, 3:27 (2002).
Rey et al., "Diversity of Dicotyledenous-Infecting Geminiviruses and Their Associated DNA Molecules in Southern Africa, Including the South-West Indian Ocean Islands," *Viruses*, 4:1753-1791 (2012).
Reynolds et al., "Rational siRNA design for RNA interference," *Nature Biotechnology*, 22:326-330 (2004).
Ryabov et al., "Cell-to-Cell, but Not Long-Distance, Spread of RNA Silencing That Is Induced in Individual Epidermal Cells," *Journal of Virology*, 78(6):3149-3154 (2004).
Ryan, "Human endogenous retroviruses in health and disease: a symbiotic perspective," *Journal of the Royal Society of Medicine*, 97:560-565 (2004).
Santoro et al., "A general purpose RNA-cleaving DNA enzyme," *Proc. Natl. Acad. Sci. USA*, 94:4262-4266 (1997).
Sathasivan et al., "Nucleotide sequence of a mutant acetolactate synthase gene from an imidazolinone-resistant *Arabidopsis thaliana* var. Columbia," *Nucleic Acids Research*, 18(8):2188-2193 (1990).
Schwab et al., "RNA silencing amplification in plants: Size matters," *PNAS*, 107(34):14945-14946 (2010).
Schwember et al., "Drying Rates following Priming Affect Temperature Sensitivity of Germination and Longevity of Lettuce Seeds," *HortScience*, 40(3):778-781 (2005).
Second Chinese Office Action issued in Chinese Patent Application No. 201180012795.2, dated Jun. 10, 2014.
Seidman et al., "The potential for gene repair via triple helix formation," *J Clin Invest.*, 112(4):487-494 (2003).
Selvarani et al., "Evaluation of seed priming methods to improve seed vigour of onion (*Allium cepa* cv. *Aggregatum*) and carrot (*Daucus carota*)," *Journal of Agricultural Technology*, 7(3):857-867 (2011).
Sharma et al., "A simple and efficient *Agrobacterium*-mediated procedure for transformation of tomato," *J. Biosci.*, 34(3):423 433 (2009).
Sijen et al., "On the Role of RNA Amplification in dsRNA-Triggered Gene Silencing," *Cell*, 107:465-476 (2001).
Silwet L-77 Spray Adjuvant for agricultural applications, product description from Momentive Performance Materials, Inc. (2003).

Singh et al., "Absorption and translocation of glyphosate with conventional and organosilicone adjuvants," *Weed Biology and Management*, 8:104-111 (2008).
Steeves et al., "Transgenic soybeans expressing siRNAs specific to a major sperm protein gene suppress *Heterodera glycines* reproduction," *Funct. Plant Biol.*, 33:991-999 (2006).
Stock et al., "Possible Mechanisms for Surfactant-Induced Foliar Uptake of Agrochemicals," *Pestic. Sci.*, 38:165-177 (1993).
Strat et al., "Specific and nontoxic silencing in mammalian cells with expressed long dsRNAs," *Nucleic Acids Research*, 34(13):3803-3810 (2006).
Sudarsan et al., "Metabolite-binding RNA domains are present in the genes of eukaryotes," *RNA*, 9:644-647 (2003).
Sun et al., "Antisense oligodeoxynucleotide inhibition as a potent strategy in plant biology: identification of SUSIBA2 as a transcriptional activator in plant sugar signalling," *The Plant Journal*, 44:128-138 (2005).
Sun et al., "A Highly efficient Transformation Protocol for Micro-Tom, a Model Cultivar for Tomato Functional Genomics," *Plant Cell Physiol.*, 47(3):426-431 (2006).
Sun et al., "Sweet delivery—sugar translocators as ports of entry for antisense oligodeoxynucleotides in plant cells," *The Plant Journal*, 52:1192-1198 (2007).
Takasaki et al., "An Effective Method for Selecting siRNA Target Sequences in Mammalian Cells," *Cell Cycle*, 3:790-795 (2004).
Temple et al., "Can glutamine synthetase activity levels be modulated in transgenic plants by the use of recombinant DNA technology?" *Transgenic Plants and Plant Biochemistry*, 22:915-920 (1994).
Temple et al., "Down-regulation of specific members of the glutamine synthetase gene family in Alfalfa by antisense RNA technology," *Plant Molecular Biology*, 37:535-547 (1998).
Templeton et al., "Improved DNA: liposome complexes for increased systemic delivery and gene expression," *Nature Biotechnology*, 15:647-652 (1997).
Tenllado et al., "Crude extracts of bacterially expressed dsRNA can be used to protect plants against virus infection," *BMC Biotechnology*, 3(3):1-11 (2003).
Tenllado et al., "RNA interference as a new biotechnological tool for the control of virus diseases in plants," *Virus Research*, 102:85-96 (2004).
Tepfer, "Risk assessment of virus resistant transgenic plants," *Annual Review of Phytopathology*, 40:467-491 (2002).
The Seed Biology Place, Website Gerhard Leubner Lab Royal Holloway, University of London, <http://www.seedbiology.de/seedtechnology.asp.
Third Party Submission filed on Nov. 29, 2012 in U.S. Appl. No. 13/042,856.
Thompson, et al., "Clustal W: improving the sensitivity of progressive multiple sequence alignment through sequence weighting, position-specific gap penalties and weight matrix choice," *Nucl. Acids Res.*, 22(22):4673-4680 (1994).
Timmons et al., "Specific interference by ingested dsRNA," *Nature*, 395:854 (1998).
Tomari et al., "Perspective: machines for RNAi," *Genes & Dev.*, 19:517-529 (2005).
Töpfer et al., "Uptake and Transient Expression of Chimeric Genes in Seed-Derived Embryos," *Plant Cell*, 1:133-139 (1989).
Toriyama et al., "Transgenic Rice Plants After Direct Gene Transfer Into Protoplasts," *Bio/Technology*, 6:1072-1074 (1988).
Tran et al., "Control of specific gene expression in mammalian cells by co-expression of long complementary RNAs," *FEBS Lett.*;573(1-3):127-134 (2004).
Turina et al., "Tospoviruses in the Mediterranean Area," *Advances in Virus Research*, 84:403-437 (2012).
Tuschl, "RNA Interference and Small Interfering RNAs," *ChemBiochem*. 2(4):239-245 (2001).
Tuschl, "Expanding small RNA interference," *Nature Biotechnol.*, 20: 446-448 (2002).
Ui-Tei et al., "Guidelines for the selection of highly effective siRNA sequences for mammalian and chick RNA interference," *Nucleic Acids Res.*, 32(3): 936-948 (2004).

(56) References Cited

OTHER PUBLICATIONS

Unnamalai et al., "Cationic oligopeptide-mediated delivery of dsRNA for post-transcriptional gene silencing in plant cells," *FEBS Letters*, 566:307-310 (2004).
Unniraman et al., "Alternate Paradigm for Intrinsic Transcription Termination in Eubacteria," *The Journal of Biological Chemistry*, 276(45)(9):41850-41855 (2001).
Urayama et al., "Knock-down of OsDCL2 in Rice Negatively Affects Maintenance of the Endogenous dsRNA Virus, *Oryza sativa* Endornavirus," *Plant and Cell Physiology*, 51(1):58-67 (2010).
van de Wetering et al., "Specific inhibition of gene expression using a stably integrated, inducible small-interfering-RNA vector," *EEMBO Rep.*, 4(6):609-615 (2003).
Vasil et al., "Herbicide Resistant Fertile Transgenic Wheat Plants Obtained by Microprojectile Bombardment of Regenerable Embryogenic Callus," *Bio/Technology*, 10:667-674 (1992).
Vaucheret, "Post-transcriptional small RNA pathways in plants: mechanisms and regulations," *Genes Dev.*, 20:759-771 (2006).
Vencill et al., "Resistance of Weeds to Herbicides," *Herbicides and Environment*, 29:585-594 (2011).
Verma et al., "Modified oligonucleotides: synthesis and strategy for users," *Annu. Rev. Biochem.*, 67:99-134 (1998).
Vert et al., "An accurate and interpretable model for siRNA efficacy prediction," *BMC Bioinformatics*, 7:520 (2006).
Vionnet et al., "Systemic Spread of Sequence-Specific Transgene RNA Degradation in Plants Is Initiated by Localized Introduction of Ectopic Promoterless DNA," *Cell*, 95:177-187 (1998).
Wakelin et al., "A target-site mutation is present in a glyphosate-resistant *Lolium rigidum* population," *Weed Res. (Oxford)*, 46(5):432-440 (2006).
Walton et al., "Prediction of antisense oligonucleotide binding affinity to a structured RNA target," *Biotechnol Bioeng* 65(1):1-9 (1999).
Wan et al., "Generation of Large Numbers of Independently Transformed Fertile Barley Plants," *Plant Physiol.*, 104:37-48 (1994).
Wardell, "Floral Induction of Vegetative Plants Supplied a Purified Fraction of Deoxyribonucleic Acid from Stems of Flowering Plants," *Plant Physiol*, 60:885-891 (1977).
Wardell, "Floral Activity in Solutions of Deoxyribonucleic Acid Extracted from Tobacco Stems," *Plant Physiol*, 57:855-861 (1976).
Waterhouse et al., "Virus resistance and gene silencing in plants can be induced by simultaneous expression of sense and antisense RNA," *Proc Natl Acad Sci USA*, 95 13959-13964 (1998).
Welch et al., "Expression of ribozymes in gene transfer systems to modulate target RNA levels," *Curr Opin Biotechnol.* 9(5):486-496 (1998).
Wilson, et al., "Transcription termination at intrinsic terminators: The role of the RNA hairpin," *Proc. Natl. Acad. Sci. USA*, 92:8793-8797 (1995).
Winkler et al., "Thiamine derivatives bind messenger RNAs directly to regulate bacterial gene expression," *Nature*, 419:952-956 (2002).
Written Opinion dated May 8, 2014, in International Application No. PCT/IL2013/050447.
Written Opinion dated Sep. 1, 2014, in Singapore Patent Application No. 201206152-9.
Xu et al., Characterization and Functional Analysis of the Calmodulin-Binding Domain of Rac1 GTPase, *Plos One*, 7(8)1-12:e42975 (2012).
Yin et al., "Production of double-stranded RNA for interference with TMV infection utilizing a bacterial prokaryotic expression system," *Appl. Microbiol. Biotechnol.*, 84(2):323-333 (2009).
YouTube video by General Electric Company "Silwet Surfactants," screen shot taken on Jan. 11, 2012 of video of www.youtube.com/watch?v=WBw7nXMqHk8 (uploaded Jul. 13, 2009).
Zagnitko, "Lolium regidum clone LS1 acetyl-CoA carboxylase mRNA, partial cds; nuclear gene for plastid product," GenBank: AF359516.1, 2 pages (2001).
Zagnitko, et al., "An isoleucine/leucine residue in the carboxyltransferase domain of acetyl-CoA carboxylase is critical for interaction with aryloxyphenoxypropionate and cyclohexanedione inhibitors," *PNAS*, 98(12):6617-6622 (2001).
Zhang et al., "A novel rice gene, NRR responds to macronutrient deficiency and regulates root growth," *Mol Plant*, 5(1):63-72 (2012).
Zhang et al., "*Agrobacterium*-mediated transformation of *Arabidopsis thaliana* using the floral dip method," *Nature Protocols*, 1(2):1-6 (2006).
Zhang et al., "Cationic lipids and polymers mediated vectors for delivery of siRNA," *Journal of Controlled Release*, 123:1-10 (2007).
Zhang et al., "DEG: a database of essential genes," *Nucleic Acids Res.*, 32:D271-D272 (2004).
Zhang et al., "Transgenic rice plants produced by electroporation-mediated plasmid uptake into protoplasts," *The Plant Cell Rep.*, 7:379-384 (1988).
Zhao et al.,"*Phyllotreta striolata* (Coleoptera: Chrysomelidae):Arginine kinase cloning and RNAi-based pest control," *European Journal of Entomology*, 105(5):815-822 (2008).
Zhu et al., "Ingested RNA interference for managing the populations of the Colorado potato beetle, *Leptinotarsa decemlineata*," *Pest Manag Sci*, 67:175-182 (2010).
Agrios, *Plant Pathology* (Second Edition), 2:466-470 (1978).
Bai et al., "Naturally Occurring Broad-Spectrum Powdery Mildew Resistance in a Central American Tomato Accession Is Caused by Loss of Mlo Function," *MPMI*, 21(1):30-39 (2008).
Bourgeois et al., "Field and producer survey of ACCase resistant wild oat in Manitoba," *Canadian Journal of Plant Science*, 709-715 (1997).
Campbell et al., "Gene-knockdown in the honey bee mite *Varroa destructor* by a non-invasive approach: studies on a glutathione S-transferase," *Parasites & Vectors*, 3(1):73, pp. 1-10 (2010).
Chang et al., "Cellular Internalization of Fluorescent Proteins via Arginine-rich Intracellular Delivery Peptide in Plant Cells," *Plant Cell Physiol.*, 46(3):482-488 (2005).
Chupp et al., "Chapter 8: White Rust," *Vegetable Diseases and Their Control*, The Ronald Press Company, New York, pp. 267-269 (1960).
Communication pursuant to Article 94(3) EPC dated Jun. 26, 2015, as received in European Patent Application No. 11 753 916.3.
Desai et al., "Reduction in deformed wing virus infection in larval and adult honey bees (*Apis mellifera* L.) by double-stranded RNA ingestion," *Insect Molecular Biology*, 21(4):446-455 (2012).
Emery et al., "Radial Patterning of *Arabidopsis* Shoots by Class III HD-ZIP and KANADI Genes," *Current Biology*, 13:1768-1774 (2003).
Extended European Search Report dated Jun. 29, 2015, in European Patent Application No. 12 831 494.5.
Final Office Action dated Nov. 7, 2013, in U.S. Appl. No. 13/042,856.
First Office Action issued May 27, 2015, in Chinese Patent Application No. 201280054179.8.
International Preliminary Report on Patentability (Chapter II) mailed Jul. 24, 2015, in International Application No. PCT/US2014/047204.
International Search Report and Written Opinion mailed Jul. 8, 2015, in International Application No. PCT/US2015/011408.
International Search Report and Written Opinion mailed Mar. 26, 2015, in International Application No. PCT/US2014/069353.
Jofre-Garfias et al., "*Agrobacterium*-mediated transformation of *Amaranthus hypochondriacus*: light- and tissue-specific expression of a pea chlorophyll a/b-binding protein promoter," *Plant Cell Reports*, 16:847-852 (1997).
Khan et al., "Matriconditioning of Vegetable Seeds to Improve Stand Establishment in Early Field Plantings," *J. Amer. Soc. Hort. Sci.*, 117(1):41-47 (1992).
Kim et al., "Synthetic dsRNA Dicer substrates enhance RNAi potency and efficacy," *Nature Biotechnology*, 23(2):222-226 (2005).
Leopold et al., "Chapter 4: Moisture as a Regulator of Physiological Reaction in Seeds," *Seed Moisture, CSSA Special Publication No. 14*, pp. 51-69 (1989).

(56) References Cited

OTHER PUBLICATIONS

MacKenzie et al., "Transgenic *Nicotiana debneyii* expressing viral coat protein are resistant to potato virus S infection," *Journal of General Virology*, 71:2167-2170 (1990).
Maori et al., "IAPV, a bee-affecting virus associated with Colony Collapse Disorder can be silenced by dsRNA ingestion," *Insect Molecular Biology*, 18(1):55-60 (2009).
Molina et al, "Inhibition of protoporphyrinogen oxidase expression in *Arabidopsis* causes a lesion-mimic phenotype that induces systemic acquired resistance," *The Plant Journal*, 17(6):667-678 (1999).
Non-Final Office Action dated Apr. 11, 2013, in U.S. Appl. No. 13/042,856.
Non-Final Office Action dated Aug. 12, 2015, in U.S. Appl. No. 13/612,936.
Non-Final Office Action dated Aug. 13, 2015, in U.S. Appl. No. 13/612,929.
Non-Final Office Action dated Jul. 23, 2015, in U.S. Appl. No. 14/335,135.
Non-Final Office Action dated Jul. 30, 2014, in U.S. Appl. No. 13/042,856.
Non-Final Office Action dated Jun. 8, 2015, in U.S. Appl. No. 13/612,941.
Non-Final Office Action dated Mar. 30, 2015, in U.S. Appl. No. 13/583,302.
Non-Final Office Action dated May 15, 2015, in U.S. Appl. No. 14/608,951.
Non-Final Office Action dated May 22, 2015, in U.S. Appl. No. 13/612,985.
Orbović et al., "Foliar-Applied Surfactants and Urea Temporarily Reduce Carbon Assimilation of Grapefruit Leaves," *J. Amer. Soc. Hort. Sci.*, 126(4):486-490 (2001).
Pratt et al., "*Amaranthus rudis* and *A. tuberculatus*, One Species or Two?," *Journal of the Torrey Botanical Society*, 128(3):282-296 (2001).
Restriction Requirement dated Apr. 21, 2015, in U.S. Appl. No. 13/612,954.
Restriction Requirement dated Feb. 12, 2015, in U.S. Appl. No. 13/612,985.
Restriction Requirement dated Mar. 4, 2015, in U.S. Appl. No. 13/612,941.
Restriction Requirement dated May 4, 2015, in U.S. Appl. No. 13/612,929.
Restriction Requirement dated May 5, 2015, in U.S. Appl. No. 13/612,936.
Restriction Requirement dated May 7, 2015, in U.S. Appl. No. 13/612,925.
Restriction Requirement dated May 7, 2015, in U.S. Appl. No. 13/612,995.
Restriction Requirement dated Oct. 2, 2012, in U.S. Appl. No. 13/042,856.
Restriction Requirement dated Oct. 21, 2014, in U.S. Appl. No. 13/583,302.
Rose et al., "Functional polarity is introduced by Dicer processing of short substrate RNAs," *Nucleic Acids Research*, 33(13):4140-4156 (2005).
Rothnie et al., Pararetroviruses and Retroviruses: A Comparative Review of Viral Structure and Gene Expression Strategies, *Advances in Virus Research*, 44:1-67 (1994).
Schweizer at al., "Double-stranded RNA interferes with gene function at the single-cell level in cereals," *The Plant Journal*, 24(6):895-903 (2000).
Senthil-Kumar et al., "A systematic study to determine the extent of gene silencing in *Nicotiana benthamiana* and other *Solanaceae* species when heterologous gene sequences are used for virus-induced gene silencing," *New Phytologist*, 176:782-791 (2007).
Snead et al., "Molecular basis for improved gene silencing by Dicer substrate interfering RNA compared with other siRNA variants," *Nucleic Acids Research*, 41(12):6209-6221 (2013).
Stevens et al., "New Formulation Technology—Silwet® Organosilicone Surfactants Have Physical and Physiological Properties Which Enhance the Performance of Sprays," *Proceedings of the 9$^{th}$ Australian Weeds Conference*, pp. 327-331 (1990).
Sutton at al., "Activity of mesotrione on resistant weeds in maize," *Pest Manag. Sci.*, 58:981-984 (2002).
Taylor, "Seed Storage, Germination and Quality," *The Physiology of Vegetable Crops*, pp. 1-36 (1997).
Tranel at al., "Resistance of weeds to ALS-inhibiting herbicides: what have we learned?," *Weed Science*, 50:700-712 (2002).
Vermeulen et al., "The contributions of dsRNA structure to Dicer specificity and efficiency," *RNA*, 11(5):674-682 (2005).

\* cited by examiner

METHODS AND COMPOSITIONS FOR WEED CONTROL

This application claims benefit under 35 USC §119(e) of U.S. provisional application Ser. No. 61/534,076 filed Sep. 13, 2011, herein incorporated by reference in it's entirety. The sequence listing that is contained in the file named "40_21(58638)B seq listing.txt", which is 849,153 bytes (measured in operating system MS-Windows) and was created on 6 Sep. 2012, is filed herewith and incorporated herein by reference.

FIELD

The methods and compositions generally relate to the field of weed management. More specifically, related to glutamine synthetase (GS) genes in plants and compositions containing polynucleotide molecules for modulating their expression. Further provided are methods and compositions useful for weed control.

BACKGROUND

Weeds are plants that compete with cultivated plants in an agronomic environment and cost farmers billions of dollars annually in crop losses and the expense of efforts to keep weeds under control. Weeds also serve as hosts for crop diseases and insect pests. The losses caused by weeds in agricultural production environments include decreases in crop yield, reduced crop quality, increased irrigation costs, increased harvesting costs, reduced land value, injury to livestock, and crop damage from insects and diseases harbored by the weeds. The principal means by which weeds cause these effects are: 1) competing with crop plants for water, nutrients, sunlight and other essentials for growth and development, 2) production of toxic or irritant chemicals that cause human or animal health problem, 3) production of immense quantities of seed or vegetative reproductive parts or both that contaminate agricultural products and perpetuate the species in agricultural lands, and 4) production on agricultural and nonagricultural lands of vast amounts of vegetation that must be disposed of. Herbicide tolerant weeds are a problem with nearly all herbicides in use, there is a need to effectively manage these weeds. There are over 365 weed biotypes currently identified as being herbicide resistant to one or more herbicides by the Herbicide Resistance Action Committee (HRAC), the North American Herbicide Resistance Action Committee (NAHRAC), and the Weed Science Society of America (WSSA).

The glutamine synthetase (GS) enzyme is an essential enzyme in the metabolism of nitrogen by catalyzing the condensation of glutamate and ammonia to form glutamine. This enzyme is the target of phosphinic acids herbicides that include glufosinate-ammonium and bialaphos.

SUMMARY

In one aspect, the invention provides a method of plant control comprising an external application to a plant of a composition comprising a polynucleotide and a transfer agent, wherein the polynucleotide is essentially identical or essentially complementary to a glutamine synthetase (GS) gene sequence or fragment thereof, or to the RNA transcript of said GS gene sequence or fragment thereof, wherein said GS gene sequence is selected from the group consisting of SEQ ID NO:1-59 or a polynucleotide fragment thereof, whereby the weedy plant growth or development or reproductive ability is reduced or the weedy plant is made more sensitive to a GS inhibitor herbicide relative to a weedy plant not treated with said composition. In this manner, plants that have become resistant to the application of GS inhibitor containing herbicides may be made more susceptible to the herbicidal effects of a GS inhibitor containing herbicide, thus potentiating the effect of the herbicide. The polynucleotide fragment is at least 18 contiguous nucleotides, at least 19 contiguous nucleotides, at least 20 contiguous nucleotides or at least 21 contiguous nucleotides in length and at least 85 percent identical to a GS gene sequence selected from the group consisting of SEQ ID NO:1-59 and the transfer agent is an organosilicone composition or compound. The polynucleotide fragment can also be sense or anti-sense ssDNA or ssRNA, dsRNA, or dsDNA, or dsDNA/RNA hybrids. The composition can include more than one polynucleotide fragments, and the composition can include a GS inhibitor herbicide and/or other herbicides (co-herbicides) that enhance the weed control activity of the composition.

In another aspect, polynucleotide molecules and methods for modulating GS gene expression in plant species are provided. The method reduces, represses or otherwise delays expression of a GS gene in a plant comprising an external application to a plant of a composition comprising a polynucleotide and a transfer agent, wherein the polynucleotide is essentially identical or essentially complementary to a GS gene sequence or fragment thereof, or to the RNA transcript of the GS gene sequence or fragment thereof, wherein the GS gene sequence is selected from the group consisting of SEQ ID NO:1-59 or a polynucleotide fragment thereof. The polynucleotide fragment is at least 18 contiguous nucleotides, at least 19 contiguous nucleotides, at least 20 contiguous nucleotides at least 21 contiguous nucleotides in length and at least 85 percent identical to a GS gene sequence selected from the group consisting of SEQ ID NO:1-59 and the transfer agent is an organosilicone compound. The polynucleotide fragment can also be sense or anti-sense ssDNA or ssRNA, dsRNA, or dsDNA, or dsDNA/RNA hybrids. Polynucleotide molecules comprising SEQ ID NOs 37-1056 are fragments of the GS gene.

In a further aspect, the polynucleotide molecule containing composition may be combined with other herbicidal (co-herbicides) compounds to provide additional control of unwanted plants in a field of cultivated plants.

In a further aspect, the polynucleotide molecule composition may be combined with any one or more additional agricultural chemicals, such as, insecticides, fungicides, nematocides, bactericides, acaricides, growth regulators, chemosterilants, semiochemicals, repellents, attractants, pheromones, feeding stimulants, biopesticides, microbial pesticides or other biologically active compounds to form a multi-component pesticide giving an even broader spectrum of agricultural protection.

DETAILED DESCRIPTION

Provided are methods and compositions containing a polynucleotide that provide for regulation, repression or delay of GS (glutamine synthetase) gene expression and enhanced control of weedy plant species and importantly GS inhibitor resistant weed biotypes. Aspects of the method can be applied to manage various weedy plants in agronomic and other cultivated environments.

The following definitions and methods are provided to better define the present invention and to guide those of ordinary skill in the art in the practice of the present invention. Unless otherwise noted, terms are to be understood according to conventional usage by those of ordinary skill in the relevant art. Where a term is provided in the singular, the inventors also contemplate aspects of the invention described by the plural of that term.

By "non-transcribable" polynucleotides is meant that the polynucleotides do not comprise a complete polymerase II transcription unit. As used herein "solution" refers to homogeneous mixtures and non-homogeneous mixtures such as suspensions, colloids, micelles, and emulsions.

Weedy plants are plants that compete with cultivated plants, those of particular importance include, but are not limited to important invasive and noxious weeds and herbicide resistant biotypes in crop production, such as, *Amaranthus* species—*A. albus, A. blitoides, A. hybridus, A. palmeri, A. powellii, A. retroflexus, A. spinosus, A. tuberculatus,* and *A. viridis; Ambrosia* species—*A. trifida, A. artemisifolia; Lolium* species—*L. multiflorum, L. rigidium, L. perenne; Digitaria* species—*D. insularis; Euphorbia* species—*E. heterophylla; Kochia* species—*K. scoparia; Sorghum* species—*S. halepense; Conyza* species—*C. bonariensis, C. canadensis, C. sumatrensis; Chloris* species—*C. truncate; Echinochola* species—*E. colona, E. crus-galli; Eleusine* species—*E. indica; Poa* species—*P. annua; Plantago* species—*P. lanceolata; Avena* species—*A. fatua; Chenopodium* species—*C. album; Setaria* species—*S. viridis, Abutilon theophrasti, Ipomoea* species, *Sesbania,* species, *Cassia* species, *Sida* species, *Brachiaria,* species and *Solanum* species.

Additional weedy plant species found in cultivated areas include *Alopecurus myosuroides, Avena sterilis, Avena sterilis ludoviciana, Brachiaria plantaginea, Bromus diandrus, Bromus rigidus, Cynosurus echinatus, Digitaria ciliaris, Digitaria ischaemum, Digitaria sanguinalis, Echinochloa oryzicola, Echinochloa phyllopogon, Eriochloa punctata, Hordeum glaucum, Hordeum leporinum, Ischaemum rugosum, Leptochloa chinensis, Lolium persicum, Phalaris minor, Phalaris paradoxa, Rottboellia exalta, Setaria faberi, Setaria viridis* var, *robusta-alba schreiber, Setaria viridis* var, *robusta*-purpurea, Snowdenia polystachea, *Sorghum sudanese, Alisma plantago-aquatica, Amaranthus lividus, Amaranthus quitensis, Ammania auriculata, Ammania coccinea, Anthemis cotula, Apera spica-venti, Bacopa rotundifolia, Bidens pilosa, Bidens subalternans, Brassica tournefortii, Bromus tectorum, Camelina microcarpa, Chrysanthemum coronarium, Cuscuta campestris, Cyperus difformis, Damasonium minus, Descurainia sophia, Diplotaxis tenuifolia, Echium plantagineum, Elatine triandra* var, *pedicellata, Euphorbia heterophylla, Fallopia convolvulus, Fimbristylis miliacea, Galeopsis tetrahit, Galium spurium, Helianthus annuus, Iva xanthifolia, Ixophorus unisetus, Ipomoea indica, Ipomoea purpurea, Ipomoea sepiaria, Ipomoea aquatic, Ipomoea triloba, Lactuca serriola, Limnocharis flava, Limnophila erecta, Limnophila sessiliflora, Lindernia dubia, Lindernia dubia* var, *major, Lindernia micrantha, Lindernia procumbens, Mesembryanthemum crystallinum, Monochoria korsakowii, Monochoria vaginalis, Neslia paniculata, Papaver rhoeas, Parthenium hysterophorus, Pentzia suffruticosa, Phalaris minor, Raphanus raphanistrum, Raphanus sativus, Rapistrum rugosum, Rotala indica* var, *uliginosa, Sagittaria guyanensis, Sagittaria montevidensis, Sagittaria pygmaea, Salsola iberica, Scirpus juncoides* var, *ohwianus, Scirpus mucronatus, Setaria lutescens, Sida spinosa, Sinapis arvensis, Sisymbrium orientale, Sisymbrium thellungii, Solanum ptycanthum, Sonchus asper, Sonchus oleraceus, Sorghum bicolor, Stellaria media, Thlaspi arvense, Xanthium strumarium, Arctotheca calendula, Conyza sumatrensis, Crassocephalum crepidiodes, Cuphea carthagenenis, Epilobium adenocaulon, Erigeron philadelphicus, Landoltia punctata, Lepidium virginicum, Monochoria korsakowii, Solanum americanum, Solanum nigrum, Vulpia bromoides, Youngia japonica, Hydrilla verticillata, Carduus nutans, Carduus pycnocephalus, Centaurea solstitialis, Cirsium arvense, Commelina diffusa, Convolvulus arvensis, Daucus carota, Digitaria ischaemum, Echinochloa crus-pavonis, Fimbristylis miliacea, Galeopsis tetrahit, Galium spurium, Limnophila erecta, Matricaria perforate, Papaver rhoeas, Ranunculus acris, Soliva sessilis, Sphenoclea zeylanica, Stellaria media, Nassella trichotoma, Stipa neesiana, Agrostis stolonifera, Polygonum aviculare, Alopecurus japonicus, Beckmannia syzigachne, Bromus tectorum, Chloris inflate, Echinochloa erecta, Portulaca oleracea,* and *Senecio vulgaris.* It is believed that all plants contain a glutamine synthetase (GS) gene in their genome, the sequence of which can be isolated and polynucleotides made according to the methods of the present invention that are useful for regulation, suppressing or delaying the expression of the target GS gene in the plants and the growth or development of the treated plants.

Some cultivated plants may also be weedy plants when they occur in unwanted environments. For example, corn plants growing in a soybean field. Transgenic crops with one or more herbicide tolerances will need specialized methods of management to control weeds and volunteer crop plants. The present invention enables the targeting of a transgene for herbicide tolerance to permit the treated plants to become sensitive to the herbicide. For example, transgene GS DNA sequences in transgenic events that include but are not limited to DP-004114-3, DAS-44406-6, DAS-68416-4, T304-40XGHB119, LLRICE601, TC-6275, LLCotton25, MS1 & RF1/RF2, Topas 19/2, Line 1507, MS6, GU262, A5547-127, T-120-7, W62, W98, A2704-12, A2704-21, A5547-35, and B16.

A "trigger" or "trigger polynucleotide" of the present invention is a polynucleotide molecule that is homologous or complementary to a target gene polynucleotide. The trigger polynucleotide molecules modulate expression of the target gene when topically applied to a plant surface with a transfer agent, whereby a plant treated with said composition has its growth or development or reproductive ability regulated, suppressed or delayed or said plant is more sensitive to a GS inhibitor herbicide as a result of said polynucleotide containing composition relative to a plant not treated with a composition containing the trigger molecule. Trigger polynucleotides disclosed herein are generally described in relation to the target gene sequence and maybe used in the sense (homologous) or antisense (complementary) orientation as single stranded molecules or comprise both strands as double stranded molecules or nucleotide variants and modified nucleotides thereof depending on the various regions of a gene being targeted.

It is contemplated that the composition of the present invention will contain multiple polynucleotides and herbicides that include but not limited to GS gene trigger polynucleotides and a GS inhibitor herbicide and anyone or more additional herbicide target gene trigger polynucleotides and the related herbicides and anyone or more additional essential gene trigger polynucleotides. Essential genes are genes in a plant that provide key enzymes or other proteins, for example, a biosynthetic enzyme, metabolizing enzyme, receptor, signal transduction protein, structural gene product, transcription factor, or transport protein; or regulating RNAs, such as, microRNAs, that are essential to the growth or survival of the organism or cell or involved in the normal growth and development of the plant (Meinke, et al., Trends Plant Sci. 2008 September; 13(9):483-91). The suppression of an essential gene enhances the effect of a herbicide that affects the function of a gene product different than the suppressed essential gene. The compositions of the present invention can include various trigger polynucleotides that modulate the expression of an essential gene other than a GS gene.

Herbicides for which transgenes for plant tolerance have been demonstrated and the method of the present invention can be applied, include but are not limited to: auxin-like herbicides, glyphosate, glufosinate, sulfonylureas, imidazolinones, bromoxynil, delapon, dicamba, cyclohezanedione, protoporphyrionogen oxidase inhibitors, 4-hydroxyphenyl-pyruvate-dioxygenase inhibitors herbicides. For example, transgenes and their polynucleotide molecules that encode proteins involved in herbicide tolerance are known in the art, and include, but are not limited to an 5-enolpyruvylshikimate-3-phosphate synthase (EPSPS), for example, as more fully described in U.S. Pat. No. 7,807,791 (SEQ ID NO:5); U.S. Pat. Nos. 6,248,876 B1; 5,627,061; 5,804,425; 5,633,435; 5,145,783; 4,971,908; 5,3372,910; 5,188,642; 4,940,835; 5,866,775; 6,225,114 B1; 6,130,366; 5,3370,667; 4,535,060; 4,769,061; 5,633,448; 5,510,471; U.S. Pat. No. Re. 36,449; U.S. Pat. Nos. RE 37,287 E; and 5,491,288; tolerance to sulfonylurea and/or imidazolinone, for example, as described more fully in U.S. Pat. Nos. 5,605,011; 5,013,659; 5,141,870; 5,767,361; 5,7337,180; 5,304,732; 4,761,373; 5,3337,107; 5,928,937; and 5,378,824; and international publication WO 96/33270; tolerance to hydroxyphenylpyruvatedioxygenases inhibiting herbicides in plants are described in U.S. Pat. Nos. 6,245,968 B1; 6,268,549; and 6,069,115; US Pat. Pub. 20110191897 and U.S. Pat. No. 7,3372,379 SEQ ID NO:3; U.S. Pat. No. 7,935,869; U.S. Pat. No. 7,304,209, SEQ ID NO:1, 3,5 and 15; aryloxyalkanoate dioxygenase polynucleotides, which confer tolerance to 2,4-D and other phenoxy auxin herbicides as well as to aryloxyphenoxypropionate herbicides as described, for example, in WO2005/107437; U.S. Pat. No. 7,838,733 SEQ ID NO:5;) and dicamba-tolerance polynucleotides as described, for example, in Herman et al. (2005) J. Biol. Chem. 280: 24759-24767. Other examples of herbicide-tolerance traits include those conferred by polynucleotides encoding an exogenous phosphinothricin acetyltransferase, as described in U.S. Pat. Nos. 5,969,213; 5,489,520; 5,550,3378; 5,874,265; 5,919,675; 5,561,236; 5,648,477; 5,646,024; 6,177,616; and 5,879,903. Plants containing an exogenous phosphinothricin acetyltransferase can exhibit improved tolerance to glufosinate herbicides, which inhibit the enzyme glutamine synthetase. Additionally, herbicide-tolerance polynucleotides include those conferred by polynucleotides conferring altered protoporphyrinogen oxidase (protox) activity, as described in U.S. Pat. Nos. 6,288,306 B1; 6,282,837 B1; and 5,767,373; and WO 01/12825. Plants containing such polynucleotides can exhibit improved tolerance to any of a variety of herbicides which target the protox enzyme (also referred to as protox inhibitors). Polynucleotides encoding a glyphosate oxidoreductase and a glyphosate-N-acetyl transferase (GOX described in U.S. Pat. No. 5,463,175 and GAT described in U.S. Patent publication 20030083480, dicamba monooxygenase U.S. Patent publication 20030135879, all of which are incorporated herein by reference); a polynucleotide molecule encoding bromoxynil nitrilase (Bxn described in U.S. Pat. No. 4,810,648 for Bromoxynil tolerance, which is incorporated herein by reference); a polynucleotide molecule encoding phytoene desaturase (crtI) described in Misawa et al, (1993) *Plant J.* 4:833-840 and Misawa et al, (1994) *Plant J.* 6:481-489 for norflurazon tolerance; a polynucleotide molecule encoding acetohydroxyacid synthase (AHAS, aka ALS) described in Sathasiivan et al. (1990) *Nucl. Acids Res.* 18:3378-2193 for tolerance to sulfonylurea herbicides; and the bar gene described in DeBlock, et al. (1987) *EMBO J.* 6:2513-2519 for glufosinate and bialaphos tolerance. The transgenic coding regions and regulatory elements of the herbicide tolerance genes are targets in which polynucleotide triggers and herbicides can be included in the composition of the present invention.

The compositions include a component that is a GS inhibitor herbicide, which include members of the Phosphinic acids herbicide group such as glufosinate-ammonium and bialaphos.

Numerous herbicides with similar or different modes of action (herein referred to as co-herbicides) are available that can be added to the composition of the present invention, for example, members of the herbicide families that include but are not limited to amide herbicides, aromatic acid herbicides, arsenical herbicides, benzothiazole herbicides, benzoylcyclohexanedione, benzofuranyl alkylsulfonate herbicides, carbamate herbicides, cyclohexene oxime herbicides, cyclopropylisoxazole herbicides, dicarboximide herbicides, dinitroaniline herbicides, dinitrophenol herbicides, diphenyl ether herbicides, dithiocarbamate herbicides, halogenated aliphatic herbicides, imidazolinone herbicides, inorganic herbicides, nitrile herbicides, organophosphorus herbicides, oxadiazolone herbicides, oxazole herbicides, phenoxy herbicides, phenylenediamine herbicides, pyrazole herbicides, pyridazine herbicides, pyridazinone herbicides, pyridine herbicides, pyrimidinediamine herbicides, pyrimidinyloxybenzylamine herbicides, quaternary ammonium herbicides, thiocarbamate herbicides, thiocarbonate herbicides, thiourea herbicides, triazine herbicides, triazinone herbicides, triazole herbicides, triazolone herbicides, triazolopyrimidine herbicides, uracil herbicides, and urea herbicides. In particular, the rates of use of the added herbicides can be reduced in compositions comprising the polynucleotides of the invention. Use rate reductions of the additional added herbicides can be 10-25 percent, 26-50 percent, 51-75 percent or more can be achieved that enhance the activity of the polynucleotides and herbicide composition and is contemplated as an aspect of the invention. Representative co-herbicides of the families include but are not limited to acetochlor, acifluorfen, acifluorfen-sodium, aclonifen, acrolein, alachlor, alloxydim, allyl alcohol, ametryn, amicarbazone, amidosulfuron, aminopyralid, amitrole, ammonium sulfamate, anilofos, asulam, atraton, atrazine, azimsulfuron, BCPC, beflubutamid, benazolin, benfluralin, benfuresate, bensulfuron, bensulfuron-methyl, bensulide, bentazone, benzfendizone, benzobicyclon, benzofenap, bifenox, bilanafos, bispyribac, bispyribac-sodium, borax, bromacil, bromobutide, bromoxynil, butachlor, butafenacil, butamifos, butralin, butroxydim, butylate, cacodylic acid, calcium chlorate, cafenstrole, carbetamide, carfentrazone, carfentrazone-ethyl, CDEA, CEPC, chlorflurenol, chlorflurenol-methyl, chloridazon, chlorimuron, chlorimuron-ethyl, chloroacetic acid, chlorotoluron, chlorpropham, chlorsulfuron, chlorthal, chlorthal-dimethyl, cinidon-ethyl, cinmethylin, cinosulfuron, cisanilide, clethodim, clodinafop, clodinafop-propargyl, clomazone, clomeprop, clopyralid, cloransulam, cloransulam-methyl, CMA, 4-CPB, CPMF, 4-CPP, CPPC, cresol, cumyluron, cyanamide, cyanazine, cycloate, cyclosulfamuron, cycloxydim, cyhalofop, cyhalofop-butyl, 2,4-D, 3,4-DA, daimuron, dalapon, dazomet, 2,4-DB, 3,4-DB, 2,4-DEB, desmedipham, dicamba, dichlobenil, orthodichlorobenzene, para-dichlorobenzene, dichlorprop, dichlorprop-P, diclofop, diclofop-methyl, diclosulam, difenzoquat, difenzoquat metilsulfate, diflufenican, diflufenzopyr, dimefuron, dimepiperate, dimethachlor, dimethametryn, dimethenamid, dimethenamid-P, dimethipin, dimethylarsinic acid, dinitramine, dinoterb, diphenamid, diquat, diquat dibromide, dithiopyr, diuron, DNOC, 3,4-DP, DSMA, EBEP, endothal, EPTC, esprocarb, ethalfluralin, ethametsulfuron, ethametsulfuron-methyl, ethofumesate, ethoxyfen, ethoxysulfuron, etobenzanid, fenoxaprop-P, fenoxaprop-P-ethyl, fentrazamide, ferrous sulfate, flamprop-M, flazasulfuron, florasulam, fluazifop, fluazifop-butyl, fluazifop-P, fluazifop-P-butyl, flucarbazone, flucarbazone-sodium, flucetosulfuron, fluchloralin, flufenacet, flufenpyr, flufenpyr-ethyl, flumetsulam, flumiclorac, flumiclorac-pentyl, flumioxazin, fluometuron, fluoroglycofen, fluoroglycofen-ethyl, flupropanate, flupyrsulfuron, flupyrsulfuron-methyl-sodium, flurenol, fluridone, fluorochloridone, fluoroxypyr, flurtamone, fluthiacet, fluthiacet-methyl, fomesafen, foramsulfuron, fosamine, glufosinate, glufosinate-ammonium, glyphosate, halosulfuron, halosulfuron-methyl, haloxyfop, haloxyfop-P, HC-252, hexazinone, imazamethabenz, imazamethabenz-methyl, imazamox, imazapic, imazapyr, imazaquin, imazethapyr, imazosulfuron, indanofan, iodomethane, iodosulfuron, iodosulfuron-methyl-sodium, ioxynil, isoproturon, isouron, isoxaben, isoxachlortole, isoxaflutole, karbutilate, lactofen, lenacil, linuron, MAA, MAMA, MCPA, MCPA-thioethyl, MCPB, mecoprop, mecoprop-P, mefenacet, mefluidide, mesosulfuron, mesosulfuron-methyl, mesotrione, metam, metamifop, metamitron, metazachlor, methabenzthiazuron, methylarsonic acid, methyldymron, methyl isothiocyanate, metobenzuron, metolachlor, S-metolachlor, metosulam, metoxuron, metribuzin, metsulfuron, metsulfuron-methyl, MK-66, molinate, monolinuron, MSMA, naproanilide, napropamide, naptalam, neburon, nicosulfuron, nonanoic acid, norflurazon, oleic acid (fatty acids), orbencarb, orthosulfamuron, oryzalin, oxadiargyl, oxadiazon, oxasulfuron, oxaziclomefone, oxyfluorfen, paraquat, paraquat dichloride, pebulate, pendimethalin, penoxsulam, pentachlorophenol, pentanochlor, pentoxazone, pethoxamid, petrolium oils, phenmedipham, phenmedipham-ethyl, picloram, picolinafen, pinoxaden, piperophos, potassium arsenite, potassium azide, pretilachlor, primisulfuron, primisulfuron-methyl, prodiamine, profluazol, profoxydim, prometon, prometryn, propachlor, propanil, propaquizafop, propazine, propham, propisochlor, propoxycarbazone, propoxycarbazone-sodium, propyzamide, prosulfocarb, prosulfuron, pyraclonil, pyraflufen, pyraflufen-ethyl, pyrazolynate, pyrazosulfuron, pyrazosulfuron-ethyl, pyrazoxyfen, pyribenzoxim, pyributicarb, pyridafol, pyridate, pyriftalid, pyriminobac, pyriminobac-methyl, pyrimisulfan, pyrithiobac, pyrithiobac-sodium, quinclorac, quinmerac, quinoclamine, quizalofop, quizalofop-P, rimsulfuron, sethoxydim, siduron, simazine, simetryn, SMA, sodium arsenite, sodium azide, sodium chlorate, sulcotrione, sulfentrazone, sulfometuron, sulfometuron-methyl, sulfosate, sulfosulfuron, sulfuric acid, tar oils, 2,3,6-TBA, TCA, TCA-sodium, tebuthiuron, tepraloxydim, terbacil, terbumeton, terbuthylazine, terbutryn, thenylchlor, thiazopyr, thifensulfuron, thifensulfuron-methyl, thiobencarb, tiocarbazil, topramezone, tralkoxydim, tri-allate, triasulfuron, triaziflam, tribenuron, tribenuron-methyl, tricamba, triclopyr, trietazine, trifloxysulfuron, trifloxysulfuron-sodium, trifluralin, triflusulfuron, triflusulfuron-methyl, trihydroxytriazine, tritosulfuron, [3-[2-chloro-4-fluoro-5-(-methyl-6-trifluoromethyl-2,4-dioxo-,2,3,4-tetrahydropyrimidin-3-yl)phenoxy]-2-pyridyloxy]acetic acid ethyl ester (CAS RN 353292-3-6), 4-[(4,5-dihydro-3-methoxy-4-methyl-5-oxo)-H-,2,4-triazol-ylcarbonyl-sulfamoyl]-5-methylthiophene-3-carboxylic acid (BAY636), BAY747 (CAS RN 33504-84-2), topramezone (CAS RN 2063-68-8), 4-hydroxy-3-[[2-[(2-methoxyethoxy)methyl]-6-(trifluoro-methyl)-3-pyridinyl]carbonyl]-bicyclo[3,2]oct-3-en-2-one (CAS RN 35200-68-5), and 4-hydroxy-3-[[2-(3-methoxypropyl)-6-(difluoromethyl)-3-pyridinyl]carbon-yl]-bicyclo[3.2.]oct-3-en-2-one. Additionally, including herbicidal compounds of unspecified modes of action as described in CN101279950A, CN101279951A, DE10000600A1, DE10116399A1, DE102004054666A1, DE102005014638A1, DE102005014906A1, DE102007012168A1, DE102010042866A1, DE10204951A1, DE10234875A1, DE10234876A1, DE10256353A1, DE10256354A1, DE10256367A1, EP1157991A2, EP1238586A1, EP2147919A1, EP2160098A2, JP03968012B2, JP2001253874A, JP2002080454A, JP2002138075A, JP2002145707A, JP2002220389A, JP2003064059A, JP2003096059A, JP2004051628A, JP2004107228A, JP2005008583A, JP2005239675A, JP2005314407A, JP2006232824A, JP2006282552A, JP2007153847A, JP2007161701A, JP2007182404A, JP2008074840A, JP2008074841A, JP2008133207A, JP2008133218A, JP2008169121A, JP2009067739A, JP2009114128A, JP2009126792A, JP2009137851A, US20060111241A1, US20090036311A1, US20090054240A1, US20090215628A1, US20100099561A1, US20100152443A1, US20110105329A1, US20110201501A1, WO2001055066A2, WO2001056975A1, WO2001056979A1, WO2001090071A2, WO2001090080A1, WO2002002540A1, WO2002028182A1, WO2002040473A1, WO2002044173A2, WO2003000679A2, WO2003006422A1, WO2003013247A1, WO2003016308A1, WO2003020704A1, WO2003022051A1, WO2003022831A1, WO2003022843A1, WO2003029243A2, WO2003037085A1, WO2003037878A1, WO2003045878A2, WO2003050087A2, WO2003051823A1, WO2003051824A1, WO2003051846A2, WO2003076409A1, WO2003087067A1, WO2003090539A1, WO2003091217A1, WO2003093269A2, WO2003104206A2, WO2004002947A1, WO2004002981A2, WO2004011429A1, WO2004029060A1, WO2004035545A2, WO2004035563A1, WO2004035564A1, WO2004037787A1, WO2004067518A1, WO2004067527A1, WO2004077950A1, WO2005000824A1, WO2005007627A1, WO2005040152A1, WO2005047233A1, WO2005047281A1, WO2005061443A2, WO2005061464A1, WO2005068434A1, WO2005070889A1, WO2005089551A1, WO2005095335A1, WO2006006569A1, WO2006024820A1, WO2006029828A1, WO2006029829A1, WO2006037945A1, WO2006050803A1, WO2006090792A1, WO2006123088A2, WO2006125687A1, WO2006125688A1, WO2007003294A1, WO2007026834A1, WO2007071900A1, WO2007077201A1, WO2007077247A1, WO2007096576A1, WO2007119434A1, WO2007134984A1, WO2008009908A1, WO2008029084A1, WO2008059948A1, WO2008071918A1, WO2008074991A1,
WO2008084073A1, WO2008100426A2,
WO2008102908A1, WO2008152072A2,
WO2008152073A2, WO2009000757A1,
WO2009005297A2, WO2009035150A2,
WO2009063180A1, WO2009068170A2,
WO2009068171A2, WO2009086041A1,
WO2009090401A2, WO2009090402A2,
WO2009115788A1, WO2009116558A1,
WO2009152995A1, WO2009158258A1,
WO2010012649A1, WO2010012649A1,
WO2010026989A1, WO2010034153A1,
WO2010049270A1, WO2010049369A1,
WO2010049405A1, WO2010049414A1,
WO2010063422A1, WO2010069802A1,
WO2010078906A2, WO2010078912A1,
WO2010104217A1, WO2010108611A1,
WO2010112826A3, WO2010116122A3,
WO2010119906A1, WO2010130970A1,
WO2011003776A2, WO2011035874A1,
WO2011065451A1, all of which are incorporated herein by reference.

An agronomic field in need of plant control is treated by application of the composition directly to the surface of the growing plants, such as by a spray. For example, the method is applied to control weeds in a field of crop plants by spraying the field with the composition. The composition can be provided as a tank mix, a sequential treatment of components (generally the polynucleotide containing composition followed by the herbicide), or a simultaneous treatment or mixing of one or more of the components of the composition from separate containers. Treatment of the field can occur as often as needed to provide weed control and the components of the composition can be adjusted to target specific weed species or weed families through utilization of specific polynucleotides or polynucleotide compositions capable of selectively targeting the specific species or plant family to be controlled. The composition can be applied at effective use rates according to the time of application to the field, for example, preplant, at planting, post planting, post harvest. GS inhibitor herbicides can be applied to a field at rates of 100 to 500 g ai/ha (active ingredient per hectare) or more. The polynucleotides of the composition can be applied at rates of 1 to 30 grams per acre depending on the number of trigger molecules needed for the scope of weeds in the field.

Crop plants in which weed control is needed include but are not limited to, i) corn, soybean, cotton, canola, sugar beet, alfalfa, sugarcane, rice, and wheat; ii) vegetable plants including, but not limited to, tomato, sweet pepper, hot pepper, melon, watermelon, cucumber, eggplant, cauliflower, broccoli, lettuce, spinach, onion, peas, carrots, sweet corn, Chinese cabbage, leek, fennel, pumpkin, squash or gourd, radish, Brussels sprouts, tomatillo, garden beans, dry beans, or okra; iii) culinary plants including, but not limited to, basil, parsley, coffee, or tea; or, iv) fruit plants including but not limited to apple, pear, cherry, peach, plum, apricot, banana, plantain, table grape, wine grape, citrus, avocado, mango, or berry; v) a tree grown for ornamental or commercial use, including, but not limited to, a fruit or nut tree; or, vi) an ornamental plant (e.g., an ornamental flowering plant or shrub or turf grass). The methods and compositions provided herein can also be applied to plants produced by a cutting, cloning, or grafting process (i.e., a plant not grown from a seed) include fruit trees and plants that include, but are not limited to, citrus, apples, avocados, tomatoes, eggplant, cucumber, melons, watermelons, and grapes as well as various ornamental plants.

Pesticidal Mixtures

The polynucleotide compositions may also be used as mixtures with various agricultural chemicals and/or insecticides, miticides and fungicides, pesticidal and biopesticidal agents. Examples include but are not limited to azinphosmethyl, acephate, isoxathion, isofenphos, ethion, etrimfos, oxydemeton-methyl, oxydeprofos, quinalphos, chlorpyrifos, chlorpyrifos-methyl, chlorfenvinphos, cyanophos, dioxabenzofos, dichlorvos, disulfoton, dimethylvinphos, dimethoate, sulprofos, diazinon, thiometon, tetrachlorvinphos, temephos, tebupirimfos, terbufos, naled, vamidothion, pyraclofos, pyridafenthion, pirimiphos-methyl, fenitrothion, fenthion, phenthoate, flupyrazophos, prothiofos, propaphos, profenofos, phoxime, phosalone, phosmet, formothion, phorate, malathion, mecarbam, mesulfenfos, methamidophos, methidathion, parathion, methyl parathion, monocrotophos, trichlorphon, EPN, isazophos, isamidofos, cadusafos, diamidaphos, dichlofenthion, thionazin, fenamiphos, fosthiazate, fosthietan, phosphocarb, DSP, ethoprophos, alanycarb, aldicarb, isoprocarb, ethiofencarb, carbaryl, carbosulfan, xylylcarb, thiodicarb, pirimicarb, fenobucarb, furathiocarb, propoxur, bendiocarb, benfuracarb, methomyl, metolcarb, XMC, carbofuran, aldoxycarb, oxamyl, acrinathrin, allethrin, esfenvalerate, empenthrin, cycloprothrin, cyhalothrin, gamma-cyhalothrin, lambda-cyhalothrin, cyfluthrin, beta-cyfluthrin, cypermethrin, alpha-cypermethrin, zeta-cypermethrin, silafluofen, tetramethrin, tefluthrin, deltamethrin, tralomethrin, bifenthrin, phenothrin, fenvalerate, fenpropathrin, furamethrin, prallethrin, flucythrinate, fluvalinate, flubrocythrinate, permethrin, resmethrin, ethofenprox, cartap, thiocyclam, bensultap, acetamiprid, imidacloprid, clothianidin, dinotefuran, thiacloprid, thiamethoxam, nitenpyram, chlorfluazuron, diflubenzuron, teflubenzuron, triflumuron, novaluron, noviflumuron, bistrifluoron, fluazuron, flucycloxuron, flufenoxuron, hexaflumuron, lufenuron, chromafenozide, tebufenozide, halofenozide, methoxyfenozide, diofenolan, cyromazine, pyriproxyfen, buprofezin, methoprene, hydroprene, kinoprene, triazamate, endosulfan, chlorfenson, chlorobenzilate, dicofol, bromopropylate, acetoprole, fipronil, ethiprole, pyrethrin, rotenone, nicotine sulphate, BT (*Bacillus Thuringiensis*) agent, spinosad, abamectin, acequinocyl, amidoflumet, amitraz, etoxazole, chinomethionat, clofentezine, fenbutatin oxide, dienochlor, cyhexatin, spirodiclofen, spiromesifen, tetradifon, tebufenpyrad, binapacryl, bifenazate, pyridaben, pyrimidifen, fenazaquin, fenothiocarb, fenpyroximate, fluacrypyrim, fluazinam, flufenzin, hexythiazox, propargite, benzomate, polynactin complex, milbemectin, lufenuron, mecarbam, methiocarb, mevinphos, halfenprox, azadirachtin, diafenthiuron, indoxacarb, emamectin benzoate, potassium oleate, sodium oleate, chlorfenapyr, tolfenpyrad, pymetrozine, fenoxycarb, hydramethylnon, hydroxy propyl starch, pyridalyl, flufenerim, flubendiamide, flonicamid, metaflumizole, lepimectin, TPIC, albendazole, oxibendazole, oxfendazole, trichlamide, fensulfothion, fenbendazole, levamisole hydrochloride, morantel tartrate, dazomet, metam-sodium, triadimefon, hexaconazole, propiconazole, ipconazole, prochloraz, triflumizole, tebuconazole, epoxiconazole, difenoconazole, flusilazole, triadimenol, cyproconazole, metconazole, fluquinconazole, bitertanol, tetraconazole, triticonazole, flutriafol, penconazole, diniconazole, fenbuconazole, bromuconazole, imibenconazole, simeconazole, myclobutanil, hymexazole, imazalil, furametpyr, thifluzamide, etridiazole, oxpoconazole, oxpoconazole fumarate, pefurazoate, prothioconazole, pyrifenox, fenarimol, nuarimol, bupirimate, mepanipyrim, cyprodinil, pyrimethanil, metalaxyl, mefenoxam, oxadixyl, benalaxyl, thiophanate, thiophanate-methyl, benomyl, carbendazim, fuberidazole, thiabendazole, manzeb, propineb, zineb, metiram, maneb, ziram, thiuram, chlorothalonil, ethaboxam, oxycarboxin, carboxin, flutolanil, silthiofam, mepronil, dimethomorph, fenpropidin, fenpropimorph, spiroxamine, tridemorph, dodemorph, flumorph, azoxystrobin, kresoxim-methyl, metominostrobin, orysastrobin, fluoxastrobin, trifloxystrobin, dimoxystrobin, pyraclostrobin, picoxystrobin, iprodione, procymidone, vinclozolin, chlozolinate, flusulfamide, dazomet, methyl isothiocyanate, chloropicrin, methasulfocarb, hydroxyisoxazole, potassium hydroxyisoxazole, echlomezol, D-D, carbam, basic copper chloride, basic copper sulfate, copper nonylphenolsulfonate, oxine copper, DBEDC, anhydrous copper sulfate, copper sulfate pentahydrate, cupric hydroxide, inorganic sulfur, wettable sulfur, lime sulfur, zinc sulfate, fentin, sodium hydrogen carbonate, potassium hydrogen carbonate, sodium hypochlorite, silver, edifenphos, tolclofos-methyl, fosetyl, iprobenfos, dinocap, pyrazophos, carpropamid, fthalide, tricyclazole, pyroquilon, diclocymet, fenoxanil, kasugamycin, validamycin, polyoxins, blasticiden S, oxytetracycline, mildiomycin, streptomycin, rape seed oil, machine oil, benthiavalicarbisopropyl, iprovalicarb, propamocarb, diethofencarb, fluoroimide, fludioxanil, fenpiclonil, quinoxyfen, oxolinic acid, chlorothalonil, captan, folpet, probenazole, acibenzolar-S-methyl, tiadinil, cyflufenamid, fenhexamid, diflumetorim, metrafenone, picobenzamide, proquinazid, famoxadone, cyazofamid, fenamidone, zoxamide, boscalid, cymoxanil, dithianon, fluazinam, dichlofluanide, triforine, isoprothiolane, ferimzone, diclomezine, tecloftalam, pencycuron, chinomethionat, iminoctadine acetate, iminoctadine albesilate, ambam, polycarbamate, thiadiazine, chloroneb, nickel dimethyldithiocarbamate, guazatine, dodecylguanidine-acetate, quintozene, tolylfluanid, anilazine, nitrothalisopropyl, fenitropan, dimethirimol, benthiazole, harpin protein, flumetover, mandipropamide and penthiopyrad.

Polynucleotides

As used herein, the term "DNA", "DNA molecule", "DNA polynucleotide molecule" refers to a single-stranded DNA (ssDNA) or double-stranded DNA (dsDNA) molecule of genomic or synthetic origin, such as, a polymer of deoxyribonucleotide bases or a DNA polynucleotide molecule. As used herein, the term "DNA sequence", "DNA nucleotide sequence" or "DNA polynucleotide sequence" refers to the nucleotide sequence of a DNA molecule. As used herein, the term "RNA", "RNA molecule", "RNA polynucleotide molecule" refers to a single-stranded RNA (ssRNA) or double-stranded RNA (dsRNA) molecule of genomic or synthetic origin, such as, a polymer of ribonucleotide bases that comprise single or double stranded regions. Unless otherwise stated, nucleotide sequences in the text of this specification are given, when read from left to right, in the 5' to 3' direction. The nomenclature used herein is that required by Title 37 of the United States Code of Federal Regulations §1.822 and set forth in the tables in WIPO Standard ST.25 (1998), Appendix 2, Tables 1 and 3.

As used herein, "polynucleotide" refers to a DNA or RNA molecule containing multiple nucleotides and generally refers both to "oligonucleotides" (a polynucleotide molecule of typically 50 or fewer nucleotides in length) and polynucleotides of 51 or more nucleotides. Embodiments of this invention include compositions including oligonucleotides having a length of 18-25 nucleotides (18-mers, 19-mers, 20-mers, 21-mers, 22-mers, 23-mers, 24-mers, or 25-mers) for example, oligonucleotides SEQ ID NO:1444-2045 or fragments thereof, or medium-length polynucleotides having a length of 26 or more nucleotides (polynucleotides of 26, 27, 28, 29, 30, 337, 32, 33, 34, 35, 36, 37, 38, 39, 40, 41, 42, 43, 44, 45, 46, 47, 48, 49, 50, 51, 52, 53, 54, 55, 56, 57, 58, 59, 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, or about 300 nucleotides), for example, oligonucleotides of SEQ ID NO:60-1443 or fragments thereof or long polynucleotides having a length greater than about 300 nucleotides (for example, polynucleotides of between about 300 to about 400 nucleotides, between about 400 to about 500 nucleotides, between about 500 to about 600 nucleotides, between about 600 to about 700 nucleotides, between about 700 to about 800 nucleotides, between about 800 to about 900 nucleotides, between about 900 to about 1000 nucleotides, between about 300 to about 500 nucleotides, between about 300 to about 600 nucleotides, between about 300 to about 700 nucleotides, between about 300 to about 800 nucleotides, between about 300 to about 900 nucleotides, or about 1000 nucleotides in length, or even greater than about 1000 nucleotides in length, for example up to the entire length of a target gene including coding or non-coding or both coding and non-coding portions of the target gene), for example, polynucleotides of Table 1 (SEQ ID NO:1-59), wherein the selected polynucleotides or fragments thereof are homologous or complementary to SEQ ID NO:1-59, suppresses, represses or otherwise delays the expression of the target GS gene. A target gene comprises any polynucleotide molecule in a plant cell or fragment thereof for which the modulation of the expression of the target gene is provided by the methods and compositions of the present invention. Where a polynucleotide is double-stranded, its length can be similarly described in terms of base pairs. Oligonucleotides and polynucleotides of the present invention can be made that are essentially identical or essentially complementary to adjacent genetic elements of a gene, for example, spanning the junction region of an intron and exon, the junction region of a promoter and a transcribed region, the junction region of a 5' leader and a coding sequence, the junction of a 3' untranslated region and a coding sequence.

Polynucleotide compositions used in the various embodiments of this invention include compositions including oligonucleotides or polynucleotides or a mixture of both, including RNA or DNA or RNA/DNA hybrids or chemically modified oligonucleotides or polynucleotides or a mixture thereof. In some embodiments, the polynucleotide may be a combination of ribonucleotides and deoxyribonucleotides, for example, synthetic polynucleotides consisting mainly of ribonucleotides but with one or more terminal deoxyribonucleotides or synthetic polynucleotides consisting mainly of deoxyribonucleotides but with one or more terminal dideoxyribonucleotides. In some embodiments, the polynucleotide includes non-canonical nucleotides such as inosine, thiouridine, or pseudouridine. In some embodiments, the polynucleotide includes chemically modified nucleotides. Examples of chemically modified oligonucleotides or polynucleotides are well known in the art; see, for example, US Patent Publication 20110171287, US Patent Publication 20110171176, and US Patent Publication 20110152353, US Patent Publication, 20110152346, US Patent Publication 20110160082, herein incorporated by reference. For example, including but not limited to the naturally occurring phosphodiester backbone of an oligonucleotide or polynucleotide can be partially or completely modified with phosphorothioate, phosphorodithioate, or methylphosphonate internucleotide linkage modifications, modified nucleoside bases or modified sugars can be used in oligonucleotide or polynucleotide synthesis, and oligonucleotides or polynucleotides can be labeled with a fluorescent moiety (for example, fluorescein or rhodamine) or other label (for example, biotin).

The polynucleotides can be single- or double-stranded RNA or single- or double-stranded DNA or double-stranded DNA/RNA hybrids or modified analogues thereof, and can be of oligonucleotide lengths or longer. In more specific embodiments of the invention the polynucleotides that provide single-stranded RNA in the plant cell are selected from the group consisting of (a) a single-stranded RNA molecule (ssRNA), (b) a single-stranded RNA molecule that self-hybridizes to form a double-stranded RNA molecule, (c) a double-stranded RNA molecule (dsRNA), (d) a single-stranded DNA molecule (ssDNA), (e) a single-stranded DNA molecule that self-hybridizes to form a double-stranded DNA molecule, and (f) a single-stranded DNA molecule including a modified Pol III gene that is transcribed to an RNA molecule, (g) a double-stranded DNA molecule (dsDNA), (h) a double-stranded DNA molecule including a modified Pol III gene that is transcribed to an RNA molecule, (i) a double-stranded, hybridized RNA/DNA molecule, or combinations thereof. In some embodiments these polynucleotides include chemically modified nucleotides or non-canonical nucleotides. In some embodiments, the oligonucleotides may be blunt-ended or may comprise a 3' overhang of from 1-5 nucleotides of at least one or both of the strands. Other configurations of the oligonucleotide are known in the field and are contemplated herein. In embodiments of the method the polynucleotides include double-stranded DNA formed by intramolecular hybridization, double-stranded DNA formed by intermolecular hybridization, double-stranded RNA formed by intramolecular hybridization, or double-stranded RNA formed by intermolecular hybridization. In one embodiment the polynucleotides include single-stranded DNA or single-stranded RNA that self-hybridizes to form a hairpin structure having an at least partially double-stranded structure including at least one segment that will hybridize to RNA transcribed from the gene targeted for suppression. Not intending to be bound by any mechanism, it is believed that such polynucleotides are or will produce single-stranded RNA with at least one segment that will hybridize to RNA transcribed from the gene targeted for suppression. In certain other embodiments the polynucleotides further includes a promoter, generally a promoter functional in a plant, for example, a pol II promoter, a pol III promoter, a pol IV promoter, or a pol V promoter.

The term "gene" refers to chromosomal DNA, plasmid DNA, cDNA, intron and exon DNA, artificial DNA polynucleotide, or other DNA that encodes a peptide, polypeptide, protein, or RNA transcript molecule, and the genetic elements flanking the coding sequence that are involved in the regulation of expression, such as, promoter regions, 5' leader regions, 3' untranslated regions. Any of the components of the gene are potential targets for the oligonucleotides and polynucleotides of the present invention.

The polynucleotide molecules of the present invention are designed to modulate expression by inducing regulation or suppression of an endogenous GS gene in a plant and are designed to have a nucleotide sequence essentially identical or essentially complementary to the nucleotide sequence of an endogenous GS gene of a plant or to the sequence of RNA transcribed from an endogenous GS gene of a plant, including a transgene in a plant that provides for a herbicide resistant GS enzyme, which can be coding sequence or non-coding sequence. Effective molecules that modulate expression are referred to as "a trigger molecule, or trigger polynucleotide". By "essentially identical" or "essentially complementary" is meant that the trigger polynucleotides (or at least one strand of a double-stranded polynucleotide or portion thereof, or a portion of a single strand polynucleotide) are designed to hybridize to the endogenous gene noncoding sequence or to RNA transcribed (known as messenger RNA or an RNA transcript) from the endogenous gene to effect regulation or suppression of expression of the endogenous gene. Trigger molecules are identified by "tiling" the gene targets with partially overlapping probes or non-overlapping probes of antisense or sense polynucleotides that are essentially identical or essentially complementary to the nucleotide sequence of an endogenous gene. Multiple target sequences can be aligned and sequence regions with homology in common, according to the methods of the present invention, are identified as potential trigger molecules for the multiple targets. Multiple trigger molecules of various lengths, for example 18-25 nucleotides, 26-50 nucleotides, 51-100 nucleotides, 101-200 nucleotides, 201-300 nucleotides or more can be pooled into a few treatments in order to investigate polynucleotide molecules that cover a portion of a gene sequence (for example, a portion of a coding versus a portion of a noncoding region, or a 5' versus a 3' portion of a gene) or an entire gene sequence including coding and noncoding regions of a target gene. Polynucleotide molecules of the pooled trigger molecules can be divided into smaller pools or single molecules in order to identify trigger molecules that provide the desired effect.

The target gene RNA and DNA polynucleotide molecules (Table 1, SEQ ID NO: 1-59) are sequenced by any number of available methods and equipment. Some of the sequencing technologies are available commercially, such as the sequencing-by-hybridization platform from Affymetrix Inc. (Sunnyvale, Calif.) and the sequencing-by-synthesis platforms from 454 Life Sciences (Bradford, Conn.), Illumina/Solexa (Hayward, Calif.) and Helicos Biosciences (Cambridge, Mass.), and the sequencing-by-ligation platform from Applied Biosystems (Foster City, Calif.), as described below. In addition to the single molecule sequencing performed using sequencing-by-synthesis of Helicos Biosciences, other single molecule sequencing technologies are encompassed by the method of the invention and include the SMRT™ technology of Pacific Biosciences, the Ion Torrent™ technology, and nanopore sequencing being developed for example, by Oxford Nanopore Technologies. A GS target gene comprising DNA or RNA can be isolated using primers or probes essentially complementary or essentially homologous to SEQ ID NO:1-59 or a fragment thereof. A polymerase chain reaction (PCR) gene fragment can be produced using primers essentially complementary or essentially homologous to SEQ ID NO:1-59 or a fragment thereof that is useful to isolate a GS gene from a plant genome. SEQ ID NO: 1-59 or fragments thereof can be used in various sequence capture technologies to isolate additional target gene sequences, for example, including but not limited to Roche NimbleGen® (Madison, Wis.) and Streptavdin-coupled Dynabeads® (Life Technologies, Grand Island, N.Y.) and US20110015084, herein incorporated by reference in its entirety.

Embodiments of functional single-stranded polynucleotides have sequence complementarity that need not be 100 percent, but is at least sufficient to permit hybridization to RNA transcribed from the target gene or DNA of the target gene to form a duplex to permit a gene silencing mechanism. Thus, in embodiments, a polynucleotide fragment is designed to be essentially identical to, or essentially complementary to, a sequence of 18 or more contiguous nucleotides in either the target GS gene sequence or messenger RNA transcribed from the target gene. By "essentially identical" is meant having 100 percent sequence identity or at least about 83, 84, 85, 86, 87, 88, 89, 90, 91, 92, 93, 94, 95, 96, 97, 98, or 99 percent sequence identity when compared to the sequence of 18 or more contiguous nucleotides in either the target gene or RNA transcribed from the target gene; by "essentially complementary" is meant having 100 percent sequence complementarity or at least about 83, 84, 85, 86, 87, 88, 89, 90, 91, 92, 93, 94, 95, 96, 97, 98, or 99 percent sequence complementarity when compared to the sequence of 18 or more contiguous nucleotides in either the target gene or RNA transcribed from the target gene. In some embodiments of this invention polynucleotide molecules are designed to have 100 percent sequence identity with or complementarity to one allele or one family member of a given target gene (coding or non-coding sequence of a gene for of the present invention); in other embodiments the polynucleotide molecules are designed to have 100 percent sequence identity with or complementarity to multiple alleles or family members of a given target gene.

In certain embodiments, the polynucleotides used in the compositions that are essentially identical or essentially complementary to the target gene or transcript will comprise the predominant nucleic acid in the composition. Thus in certain embodiments, the polynucleotides that are essentially identical or essentially complementary to the target gene or transcript will comprise at least about 50%, 75%, 95%, 98% or 100% of the nucleic acids provided in the composition by either mass or molar concentration. However, in certain embodiments, the polynucleotides that are essentially identical or essentially complementary to the target gene or transcript can comprise at least about 1% to about 50%, about 10% to about 50%, about 20% to about 50%, or about 30% to about 50% of the nucleic acids provided in the composition by either mass or molar concentration. Also provided are compositions where the polynucleotides that are essentially identical or essentially complementary to the target gene or transcript can comprise at least about 1% to 100%, about 10% to 100%, about 20% to about 100%, about 30% to about 50%, or about 50% to a 100% of the nucleic acids provided in the composition by either mass or molar concentration.

"Identity" refers to the degree of similarity between two polynucleic acid or protein sequences. An alignment of the two sequences is performed by a suitable computer program. A widely used and accepted computer program for performing sequence alignments is CLUSTALW v1.6 (Thompson, et al. Nucl. Acids Res., 22: 4673-4680, 1994). The number of matching bases or amino acids is divided by the total number of bases or amino acids, and multiplied by 100 to obtain a percent identity. For example, if two 580 base pair sequences had 145 matched bases, they would be 25 percent identical. If the two compared sequences are of different lengths, the number of matches is divided by the shorter of the two lengths. For example, if there are 100 matched amino acids between a 200 and a 400 amino acid protein, they are 50 percent identical with respect to the shorter sequence. If the shorter sequence is less than 150 bases or 50 amino acids in length, the number of matches are divided by 150 (for nucleic acid bases) or 50 (for amino acids), and multiplied by 100 to obtain a percent identity.

Trigger molecules for specific gene family members can be identified from coding and/or non-coding sequences of gene families of a plant or multiple plants, by aligning and selecting 200-300 polynucleotide fragments from the least homologous regions amongst the aligned sequences and evaluated using topically applied polynucleotides (as sense or anti-sense ssDNA or ssRNA, dsRNA, or dsDNA) to determine their relative effectiveness in inducing the herbicidal phenotype. The effective segments are further subdivided into 50-60 polynucleotide fragments, prioritized by least homology, and reevaluated using topically applied polynucleotides. The effective 50-60 polynucleotide fragments are subdivided into 19-30 polynucleotide fragments, prioritized by least homology, and again evaluated for induction of the yield/quality phenotype. Once relative effectiveness is determined, the fragments are utilized singly, or again evaluated in combination with one or more other fragments to determine the trigger composition or mixture of trigger polynucleotides for providing the yield/quality phenotype.

Trigger molecules for broad activity can be identified from coding and/or non-coding sequences of gene families of a plant or multiple plants, by aligning and selecting 200-300 polynucleotide fragments from the most homologous regions amongst the aligned sequences and evaluated using topically applied polynucleotides (as sense or anti-sense ssDNA or ssRNA, dsRNA, or dsDNA) to determine their relative effectiveness in inducing the yield/quality phenotype. The effective segments are subdivided into 50-60 polynucleotide fragments, prioritized by most homology, and reevaluated using topically applied polynucleotides. The effective 50-60 polynucleotide fragments are subdivided into 19-30 polynucleotide fragments, prioritized by most homology, and again evaluated for induction of the yield/quality phenotype. Once relative effectiveness is determined, the fragments may be utilized singly, or in combination with one or more other fragments to determine the trigger composition or mixture of trigger polynucleotides for providing the yield/quality phenotype.

Methods of making polynucleotides are well known in the art. Chemical synthesis, in vivo synthesis and in vitro synthesis methods and compositions are known in the art and include various viral elements, microbial cells, modified polymerases, and modified nucleotides. Commercial preparation of oligonucleotides often provides two deoxyribonucleotides on the 3' end of the sense strand. Long polynucleotide molecules can be synthesized from commercially available kits, for example, kits from Applied Biosystems/Ambion (Austin, Tex.) have DNA ligated on the 5' end in a microbial expression cassette that includes a bacterial T7 polymerase promoter that makes RNA strands that can be assembled into a dsRNA and kits provided by various manufacturers that include T7 RiboMax Express (Promega, Madison, Wis.), AmpliScribe T7-Flash (Epicentre, Madison, Wis.), and TranscriptAid T7 High Yield (Fermentas, Glen Burnie, Md.). dsRNA molecules can be produced from microbial expression cassettes in bacterial cells (Ongvarrasopone et al. ScienceAsia 33:35-39; Yin, Appl. Microbiol. Biotechnol 84:323-333, 2009; Liu et al., BMC Biotechnology 10:85, 2010) that have regulated or deficient RNase III enzyme activity or the use of various viral vectors to produce sufficient quantities of dsRNA. In the present invention, GS gene fragments are inserted into the microbial expression cassettes in a position in which the fragments are express to produce ssRNA or dsRNA useful in the methods described herein to regulate expression on a target GS gene. Long polynucleotide molecules can also be assembled from multiple RNA or DNA fragments. In some embodiments design parameters such as Reynolds score (Reynolds et al. Nature Biotechnology 22, 326-330 (2004), Tuschl rules (Pei and Tuschl, Nature Methods 3(9): 670-676, 2006), i-score (Nucleic Acids Res 35: e123, 2007), i-Score Designer tool and associated algorithms (Nucleic Acids Res 32: 936-948, 2004. Biochem Biophys Res Commun 316: 1050-1058, 2004, Nucleic Acids Res 32: 893-901, 2004, Cell Cycle 3: 790-5, 2004, Nat Biotechnol 23: 995-1001, 2005, Nucleic Acids Res 35: e27, 2007, BMC Bioinformatics 7: 520, 2006, Nucleic Acids Res 35: e123, 2007, Nat Biotechnol 22: 326-330, 2004) are known in the art and may be used in selecting polynucleotide sequences effective in gene silencing. In some embodiments the sequence of a polynucleotide is screened against the genomic DNA of the intended plant to minimize unintentional silencing of other genes.

The trigger polynucleotide and oligonucleotide molecule compositions of this invention are useful in compositions, such as liquids that comprise the polynucleotide molecules at low concentrations, alone or in combination with other components, for example one or more herbicide molecules, either in the same solution or in separately applied liquids that also provide a transfer agent. While there is no upper limit on the concentrations and dosages of polynucleotide molecules that can useful in the methods, lower effective concentrations and dosages will generally be sought for efficiency. The concentrations can be adjusted in consideration of the volume of spray or treatment applied to plant leaves or other plant part surfaces, such as flower petals, stems, tubers, fruit, anthers, pollen, or seed. In one embodiment, a useful treatment for herbaceous plants using 25-mer oligonucleotide molecules is about 1 nanomole (nmol) of oligonucleotide molecules per plant, for example, from about 0.05 to 1 nmol per plant. Other embodiments for herbaceous plants include useful ranges of about 0.05 to about 100 nmol, or about 0.1 to about 20 nmol, or about 1 nmol to about 10 nmol of polynucleotides per plant. Very large plants, trees, or vines may require correspondingly larger amounts of polynucleotides. When using long dsRNA molecules that can be processed into multiple oligonucleotides, lower concentrations can be used. To illustrate embodiments of the invention, the factor 1×, when applied to oligonucleotide molecules is arbitrarily used to denote a treatment of 0.8 nmol of polynucleotide molecule per plant; 10×, 8 nmol of polynucleotide molecule per plant; and 100×, 80 nmol of polynucleotide molecule per plant.

The polynucleotide compositions of this invention are useful in compositions, such as liquids that comprise polynucleotide molecules, alone or in combination with other components either in the same liquid or in separately applied liquids that provide a transfer agent. As used herein, a transfer agent is an agent that, when combined with a polynucleotide in a composition that is topically applied to a target plant surface, enables the polynucleotide to enter a plant cell. In certain embodiments, a transfer agent is an agent that conditions the surface of plant tissue, e.g., leaves, stems, roots, flowers, or fruits, to permeation by the polynucleotide molecules into plant cells. The transfer of polynucleotides into plant cells can be facilitated by the prior or contemporaneous application of a polynucleotide-transferring agent to the plant tissue. In some embodiments the transferring agent is applied subsequent to the application of the polynucleotide composition. The polynucleotide transfer agent enables a pathway for polynucleotides through cuticle wax barriers, stomata and/or cell wall or membrane barriers into plant cells. Suitable transfer agents to facilitate transfer of the polynucleotide into a plant cell include agents that increase permeability of the exterior of the plant or that increase permeability of plant cells to oligonucleotides or polynucleotides. Such agents to facilitate transfer of the composition into a plant cell include a chemical agent, or a physical agent, or combinations thereof. Chemical agents for conditioning or transfer include (a) surfactants, (b) an organic solvent or an aqueous solution or aqueous mixtures of organic solvents, (c) oxidizing agents, (d) acids, (e) bases, (f) oils, (g) enzymes, or combinations thereof. Embodiments of the method can optionally include an incubation step, a neutralization step (e.g., to neutralize an acid, base, or oxidizing agent, or to inactivate an enzyme), a rinsing step, or combinations thereof. Embodiments of agents or treatments for conditioning of a plant to permeation by polynucleotides include emulsions, reverse emulsions, liposomes, and other micellar-like compositions. Embodiments of agents or treatments for conditioning of a plant to permeation by polynucleotides include counter-ions or other molecules that are known to associate with nucleic acid components, e.g., inorganic ammonium ions, alkyl ammonium ions, lithium ions, polyamines such as spermine, spermidine, or putrescine, and other cations. Organic solvents useful in conditioning a plant to permeation by polynucleotides include DMSO, DMF, pyridine, N-pyrrolidine, hexamethylphosphoramide, acetonitrile, dioxane, polypropylene glycol, other solvents miscible with water or that will dissolve phosphonucleotides in non-aqueous systems (such as is used in synthetic reactions). Naturally derived or synthetic oils with or without surfactants or emulsifiers can be used, e.g., plant-sourced oils, crop oils (such as those listed in the $9^{th}$ Compendium of Herbicide Adjuvants, publicly available on the worldwide web (internet) at herbicide-.adjuvants.com can be used, e.g., paraffinic oils, polyol fatty acid esters, or oils with short-chain molecules modified with amides or polyamines such as polyethyleneimine or N-pyrrolidine. Transfer agents include, but are not limited to, organosilicone preparations.

In certain embodiments, an organosilicone preparation that is commercially available as Silwet® L-77 surfactant having CAS Number 27306-78-1 and EPA Number: CAL-.REG.NO. 5905-50073-AA, and currently available from Momentive Performance Materials, Albany, N.Y. can be used to prepare a polynucleotide composition. In certain embodiments where a Silwet L-77 organosilicone preparation is used as a pre-spray treatment of plant leaves or other plant surfaces, freshly made concentrations in the range of about 0.015 to about 2 percent by weight (wt percent) (e.g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) are efficacious in preparing a leaf or other plant surface for transfer of polynucleotide molecules into plant cells from a topical application on the surface. In certain embodiments of the methods and compositions provided herein, a composition that comprises a polynucleotide molecule and an organosilicone preparation comprising Silwet L-77 in the range of about 0.015 to about 2 percent by weight (wt percent) (e.g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) is used or provided.

In certain embodiments, any of the commercially available organosilicone preparations provided such as the following Breakthru S 321, Breakthru S 200 Cat #67674-67-3, Breakthru OE 441 Cat#68937-55-3, Breakthru S 278 Cat #27306-78-1, Breakthru S 243, Breakthru S 233 Cat#134180-76-0, available from manufacturer Evonik Goldschmidt (Germany), Silwet® HS 429, Silwet® HS 312, Silwet® HS 508, Silwet® HS 604 (Momentive Performance Materials, Albany, N.Y.) can be used as transfer agents in a polynucleotide composition. In certain embodiments where an organosilicone preparation is used as a pre-spray treatment of plant leaves or other surfaces, freshly made concentrations in the range of about 0.015 to about 2 percent by weight (wt percent) (e.g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) are efficacious in preparing a leaf or other plant surface for transfer of polynucleotide molecules into plant cells from a topical application on the surface. In certain embodiments of the methods and compositions provided herein, a composition that comprises a polynucleotide molecule and an organosilicone preparation in the range of about 0.015 to about 2 percent by weight (wt percent) (e.g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) is used or provided.

Organosilicone preparations used in the methods and compositions provided herein can comprise one or more effective organosilicone compounds. As used herein, the phrase "effective organosilicone compound" is used to describe any organosilicone compound that is found in an organosilicone preparation that enables a polynucleotide to enter a plant cell. In certain embodiments, an effective organosilicone compound can enable a polynucleotide to enter a plant cell in a manner permitting a polynucleotide mediated suppression of a target gene expression in the plant cell. In general, effective organosilicone compounds include, but are not limited to, compounds that can comprise: i) a trisiloxane head group that is covalently linked to, ii) an alkyl linker including, but not limited to, an n-propyl linker, that is covalently linked to, iii) a poly glycol chain, that is covalently linked to, iv) a terminal group. Trisiloxane head groups of such effective organosilicone compounds include, but are not limited to, heptamethyltrisiloxane. Alkyl linkers can include, but are not limited to, an n-propyl linker. Poly glycol chains include, but are not limited to, polyethylene glycol or polypropylene glycol. Poly glycol chains can comprise a mixture that provides an average chain length "n" of about "7.5". In certain embodiments, the average chain length "n" can vary from about 5 to about 14. Terminal groups can include, but are not limited to, alkyl groups such as a methyl group. Effective organosilicone compounds are believed to include, but are not limited to, trisiloxane ethoxylate surfactants or polyalkylene oxide modified heptamethyl trisiloxane.

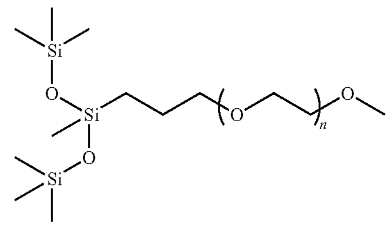

(Compound I: polyalkyleneoxide heptamethyltrisiloxane, average n=7.5).

In certain embodiments, an organosilicone preparation that comprises an organosilicone compound comprising a trisiloxane head group is used in the methods and compositions provided herein. In certain embodiments, an organosilicone preparation that comprises an organosilicone compound comprising a heptamethyltrisiloxane head group is used in the methods and compositions provided herein. In certain embodiments, an organosilicone composition that comprises Compound I is used in the methods and compositions provided herein. In certain embodiments, an organosilicone composition that comprises Compound I is used in the methods and compositions provided herein. In certain embodiments of the methods and compositions provided herein, a composition that comprises a polynucleotide molecule and one or more effective organosilicone compound in the range of about 0.015 to about 2 percent by weight (wt percent) (e.g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) is used or provided.

Compositions of the present invention include but are not limited components that are one or more polynucleotides essentially identical to, or essentially complementary to a GS gene sequence (promoter, intron, exon, 5' untranslated region, 3' untranslated region), a transfer agent that provides for the polynucleotide to enter a plant cell, a herbicide that complements the action of the polynucleotide, one or more additional herbicides that further enhance the herbicide activity of the composition or provide an additional mode of action different from the complementing herbicide, various salts and stabilizing agents that enhance the utility of the composition as an admixture of the components of the composition.

Methods include one or more applications of a polynucleotide composition and one or more applications of a permeability-enhancing agent for conditioning of a plant to permeation by polynucleotides. When the agent for conditioning to permeation is an organosilicone composition or compound contained therein, embodiments of the polynucleotide molecules are double-stranded RNA oligonucleotides, single-stranded RNA oligonucleotides, double-stranded RNA polynucleotides, single-stranded RNA polynucleotides, double-stranded DNA oligonucleotides, single-stranded DNA oligonucleotides, double-stranded DNA polynucleotides, single-stranded DNA polynucleotides, chemically modified RNA or DNA oligonucleotides or polynucleotides or mixtures thereof.

Compositions and methods are useful for modulating the expression of an endogenous GS gene (for example, Pest Manag Sci 2009; 65: 216-222, GS249 mutants) or transgenic GS gene (for example, U.S. Pat. Nos. 7,910,805; 5,969,213; 5,489,520; 5,550,318; 5,874,265; 5,919,675; 5,561,236; 5,648,477; 5,646,024; 6,177,616; and 5,879,903)

in a plant cell. In various embodiments, a GS gene includes coding (protein-coding or translatable) sequence, non-coding (non-translatable) sequence, or both coding and non-coding sequence. Compositions of the invention can include polynucleotides and oligonucleotides designed to target multiple genes, or multiple segments of one or more genes. The target gene can include multiple consecutive segments of a target gene, multiple non-consecutive segments of a target gene, multiple alleles of a target gene, or multiple target genes from one or more species.

One aspect is a method for modulating expression of a GS gene in a plant including (a) conditioning of a plant to permeation by polynucleotides and (b) treatment of the plant with the polynucleotide molecules, wherein the polynucleotide molecules include at least one segment of 18 or more contiguous nucleotides cloned from or otherwise identified from the target GS gene in either anti-sense or sense orientation, whereby the polynucleotide molecules permeate the interior of the plant and induce modulation of the target gene. The conditioning and polynucleotide application can be performed separately or in a single step. When the conditioning and polynucleotide application are performed in separate steps, the conditioning can precede or can follow the polynucleotide application within minutes, hours, or days. In some embodiments more than one conditioning step or more than one polynucleotide molecule application can be performed on the same plant. In embodiments of the method, the segment can be cloned or identified from (a) coding (protein-encoding), (b) non-coding (promoter and other gene related molecules), or (c) both coding and non-coding parts of the target gene. Non-coding parts include DNA, such as promoter regions or the RNA transcribed by the DNA that provide RNA regulatory molecules, including but not limited to: introns, 5' or 3' untranslated regions, and microRNAs (miRNA), trans-acting siRNAs, natural anti-sense siRNAs, and other small RNAs with regulatory function or RNAs having structural or enzymatic function including but not limited to: ribozymes, ribosomal RNAs, t-RNAs, aptamers, and riboswitches.

All publications, patents and patent applications are herein incorporated by reference to the same extent as if each individual publication or patent application was specifically and individually indicated to be incorporated by reference.

The following examples are included to demonstrate examples of certain preferred embodiments. It should be appreciated by those of skill in the art that the techniques disclosed in the examples that follow represent approaches the inventors have found function well in the practice of the invention, and thus can be considered to constitute examples of preferred modes for its practice. However, those of skill in the art should, in light of the present disclosure, appreciate that many changes can be made in the specific embodiments that are disclosed and still obtain a like or similar result without departing from the spirit and scope.

EXAMPLES

Example 1

Polynucleotides Related to the GS Gene Sequences

The target GS polynucleotide molecule naturally occurs in the genome of *Abutilon theophrasti, Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Ambrosia trifida, Ambrosia artemisiifolia, Chenopodium album, Commelina diffusa, Convulvulus arvensis, Conyza candensis, Lolium multiflorum, Euphorbia heterophylla, Kochia scoparia, Sorghum halepense* and *Digitaria sanguinalis* and include molecules related to the expression of a polypeptide identified as a GS, that include regulatory molecules, cDNAs comprising coding and noncoding regions of a GS gene and fragments thereof as shown in Table 1.

Polynucleotide molecules were extracted from these plant species by methods standard in the field, for example, total RNA is extracted using TRIZOL® reagent (Invitrogen Corp, Carlsbad, Calif., Cat. No. 15596-018; a monophasic solution of phenol and guanidine isothiocyanate), following the manufacturer's protocol or modifications thereof by those skilled in the art of polynucleotide extraction that may enhance recover or purity of the extracted RNA. Briefly, start with 1 gram of ground plant tissue for extraction. Prealiquot 10 milliliters (mL) TRIZOL® reagent to 15 mL conical tubes. Add ground powder to tubes and shake to homogenize. Incubate the homogenized samples for 5 minutes (min) at room temperature (RT) and then add 3 mL of chloroform. Shakes tubes vigorously by hand for 15-30 seconds (sec) and incubate at RT for 3 min. Centrifuge the tubes at 7,000 revolutions per minute (rpm) for 10 min at 4 degrees C. Transfer the aqueous phase to a new 1.5 mL tube and add 1 volume of cold isopropanol. Incubate the samples for 20-30 min at RT and centrifuge at 10,000 rpm for 10 min at 4 degrees C. Wash pellet with Sigma-grade 80 percent ethanol. Remove the supernatant and briefly air-dry the pellet. Dissolve the RNA pellet in approximately 200 microliters of DEPC treated water. Heat briefly at 65 degrees C. to dissolve pellet and vortex or pipet to resuspend RNA pellet. Adjust RNA concentration to 1-2 microgram/microliter.

DNA was extracted using EZNA SP Plant DNA Mini kit (Omega Biotek, Norcross Ga., Cat#D5511) and Lysing Matrix E tubes (Q-Biogen, Cat#6914), following the manufacturer's protocol or modifications thereof by those skilled in the art of polynucleotide extraction that may enhance recover or purity of the extracted DNA. Briefly, aliquot ground tissue to a Lysing Matrix E tube on dry ice, add 800 µl Buffer SP1 to each sample, homogenize in a bead beater for 35-45 sec, incubate on ice for 45-60 sec, centrifuge at ≥14000 rpm for 1 min at RT, add 10 microliter RNase A to the lysate, incubate at 65° C. for 10 min, centrifuge for 1 min at RT, add 280 µl Buffer SP2 and vortex to mix, incubate the samples on ice for 5 min, centrifuge at ≥10,000 g for 10 min at RT, transfer the supernatant to a homogenizer column in a 2 ml collection tube, centrifuge at 10,000 g for 2 min at RT, transfer the cleared lysate into a 1.5 ml microfuge tube, add 1.5 volumes Buffer SP3 to the cleared lysate, vortex immediately to obtain a homogeneous mixture, transfer up to 650 µl supernatant to the Hi-Bind column, centrifuge at 10,000 g for 1 min, repeat, apply 100 µl 65° C. Elution Buffer to the column, centrifuge at 10,000 g for 5 min at RT.

Next-generation DNA sequencers, such as the 454-FLX (Roche, Branford, Conn.), the SOLiD (Applied Biosystems,), and the Genome Analyzer (HiSeq2000, Illumina, San Diego, Calif.) were used to provide polynucleotide sequence from the DNA and RNA extracted from the plant tissues. Raw sequence data is assembled into contigs. The contig sequence is used to identify trigger molecules that can be applied to the plant to enable regulation of the gene expression.

The target DNA sequence isolated from genomic (gDNA) and coding DNA (cDNA) from the various weedy plant species for the GS gene and the assembled contigs were set forth in SEQ ID NOs: 1-59 and Table 1.

Example 2

Polynucleotides of the Invention Related to the Trigger Molecules

The gene sequences and fragments of Table 1 were divided into 200 polynucleotide (200-mer) lengths with 25 polynucleotide overlapping regions as in SEQ ID NO:37-1056. These polynucleotides are tested to select the most efficacious trigger regions across the length of any target sequence. The trigger polynucleotides are constructed as sense or anti-sense ssDNA or ssRNA, dsRNA, or dsDNA, or dsDNA/RNA hybrids and combined with an organosilicone based transfer agent to provide a polynucleotide preparation. The polynucleotides are combined into sets of two to three polynucleotides per set, using 4-8 nmol of each polynucleotide. Each polynucleotide set is prepared with the transfer agent and applied to a plant or a field of plants in combination with a GS inhibitor containing herbicide, or followed by a GS inhibitor treatment one to three days after the polynucleotide application, to determine the effect on the plant's susceptibility to a GS inhibitor. The effect is measured as stunting the growth and/or killing of the plant and is measured 8-14 days after treatment with the polynucleotide set and GS inhibitor. The most efficacious sets are identified and the individual polynucleotides are tested in the same methods as the sets are and the most efficacious single 200-mer identified. The 200-mer sequence is divided into smaller sequences of 50-70-mer regions with 10-15 polynucleotide overlapping regions and the polynucleotides tested individually. The most efficacious 50-70-mer is further divided into smaller sequences of 25-mer regions with a 12 to 13 polynucleotide overlapping region and tested for efficacy in combination with GS inhibitor treatment. By this method it is possible to identify an oligonucleotide or several oligonucleotides that are the most efficacious trigger molecule to effect plant sensitivity to a GS inhibitor or modulation of a GS gene expression. The modulation of GS gene expression is determined by the detection of GS siRNA molecules specific to a GS gene or by an observation of a reduction in the amount of GS RNA transcript produced relative to an untreated plant or by merely observing the anticipated phenotype of the application of the trigger with the GS inhibiting herbicide. Detection of siRNA can be accomplished, for example, using kits such as mirVana (Ambion, Austin Tex.) and mirPremier (Sigma-Aldrich, St Louis, Mo.).

The target DNA sequence isolated from genomic (gDNA) and coding DNA (cDNA) from the various weedy plant species for the GS gene and the assembled contigs as set forth in SEQ ID NOs 1-59 were divided into polynucleotide fragments as set forth in SEQ ID NOs 60-1444.

The gene sequences and fragments of Table 1 were compared and 21-mers of contiguous polynucleotides were identified that had homology across the various GS gene sequences. The purpose is to identify trigger molecules that are useful as herbicidal molecules or in combination with a GS inhibitor herbicide across a broad range of weed species. The SEQ ID NO: 1444-2045 sequences represent the 21-mers that are present in the GS gene of at least two of the weed species of Table 1. It is contemplated that additional 21-mers can be selected from the sequences of Table 1 that are specific for a single weed species or a few weeds species within a genus or trigger molecules that are at least 18 contiguous nucleotides, at least 19 contiguous nucleotides, at least 20 contiguous nucleotides or at least 21 contiguous nucleotides in length and at least 85 percent identical to a GS gene sequence selected from the group consisting of SEQ ID NO:1-59 or fragment thereof.

By this method it is possible to identify an oligonucleotide or several oligonucleotides that are the most efficacious trigger molecule to effect plant sensitivity to GS inhibitor or modulation of GS gene expression. The modulation of GS gene expression is determined by the detection of GS siRNA molecules specific to GS gene or by an observation of a reduction in the amount of GS RNA transcript produced relative to an untreated plant or by merely observing the anticipated phenotype of the application of the trigger with the GS inhibitor containing herbicide. Detection of siRNA can be accomplished, for example, using kits such as mirVana (Ambion, Austin Tex.) and mirPremier (Sigma-Aldrich, St Louis, Mo.).

The target DNA sequence isolated from genomic (gDNA) and coding DNA (cDNA) from the various weedy plant species for the GS gene and the assembled contigs as set forth in SEQ ID NOs 1-59 were divided into fragments as set forth in SEQ ID NOs 1444-2045.

Example 3

Methods Used in the Invention Related to Treating Plants or Plant Parts with a Topical Mixture of the Trigger Molecules Glyphosate-sensitive Palmer amaranth (*A. palmeri* R-22) plants were grown in the greenhouse (30/20 C day/night T; 14 hour photoperiod) in 4 inch square pots containing Sun Gro® Redi-Earth and 3.5 kg/cubic meter Osmocote® 14-14-14 fertilizer. Palmer amaranth plants at 5 to 10 cm in height were treated with a mixture of 5 short (40-mer) single-strand antisense single strand DNA polynucleotides (ssDNA) targeting GS coding sequence at 4 nm (nanomole) each, formulated in 20 millimolar sodium phosphate buffer (pH 6.8) containing 2 percent ammonium sulfate and 1 percent Silwet L-77. Three pools of ssDNA polynucleotides were tested. One pool named the GS CpGS1 contained 5 polynucleotides (SEQ ID NO: 2046-2050) that were selected to target the gene encoding the chloroplastic targeted glutamine synthetase1 gene. The second pool named GS CytGS1 contained 5 polynucleotides (SEQ ID NO: 2051-2055) that were selected to target the cytosolic glutamine synthetase1 gene. The third pool (GS Mix) was a combination of ssDNA trigger molecules, two each from the GS CpGS1 and GS CytGS1 pool plus one ssDNA (SEQ ID NO: 2056) targeting a cytosolic glutamine synthetase2 gene. Plants are treated manually by pipetting 10 μL of polynucleotide solution on four fully expanded mature leaves, for a total of 40 microliters of solution per plant. Three days after the trigger polynucleotide treatment, the plants were treated with Ignite® rate (Bayer Cropscience) at 1/32× (23 grams/hectare) field rate. There were four replications of each treatment. Plant growth and development was visually rated sixteen days after herbicide treatment to determine the efficacy of the polynucleotide pool and herbicide treatments. The result shown in Table 2 as the average percent efficacy observed of the four replications relative to the untreated control.

TABLE 2

| ssDNA trigger polynucleotide activity on Palmer Amaranth, percent efficacy | | | |
|---|---|---|---|
| Formulation control | GS CpGS1 | GS CytGS1 | GS Mix |
| 3 | 19 | 15 | 36 |

Example 4

A Method to Control Weeds in a Field

A method to control weeds in a field comprises the use of trigger polynucleotides that can modulate the expression of a GS gene in one or more target weed plant species. In SEQ ID NO: 1444-2045, an analysis of GS gene sequences from twenty-two plant species provided a collection of 21-mer polynucleotides that can be used in compositions to affect the growth or develop or sensitivity to GS inhibitor herbicide to control multiple weed species in a field. A composition containing 1 or 2 or 3 or 4 or more of the polynucleotides of SEQ ID NO: 1444-2045 would enable broad activity of the composition against the multiple weed species that occur in a field environment.

The method includes creating a composition that comprises components that include at least one polynucleotide of SEQ ID NO: 1444-2045 or any other effective gene expression modulating polynucleotide essentially identical or essentially complementary to SEQ ID NO:1-59 or fragment thereof, a transfer agent that mobilizes the polynucleotide into a plant cell and a GS inhibiting herbicide and optionally a polynucleotide that modulates the expression of an essential gene and optionally a herbicide that has a different mode of action relative to a GS inhibitor. The polynucleotide of the composition includes a dsRNA, ssDNA or dsDNA or a combination thereof. A composition containing a polynucleotide can have a use rate of about 1 to 30 grams or more per acre depending on the size of the polynucleotide and the number of polynucleotides in the composition. The composition may include one or more additional herbicides as needed to provide effective multi-species weed control. A field of crop plants in need of weed plant control is treated by spray application of the composition. The composition can be provided as a tank mix, a sequential treatment of components (generally the polynucleotide followed by the herbicide), a simultaneous treatment or mixing of one or more of the components of the composition from separate containers. Treatment of the field can occur as often as needed to provide weed control and the components of the composition can be adjusted to target specific weed species or weed families.

TABLE 1

Glutamine synthetase gene sequences isolated from various weed species

| SEQ ID NO | SPECIES | TYPE | LENGTH | SEQ |
|---|---|---|---|---|
| 1 | Amaranthus palmeri | cDNAContig | 1759 | ATTATTCCACACTCCACACTACCCATTTCATTCTGCTC GCTCTCCTTCCTTCTTTCTCACTCCTTTATCTCTCTATA TTCATCTCTCTCTAGCTTGTTCACGACGCCGACCA CCCTTTTCCGATCCCAGGTAAAAGTGACCAAACATG GCACAAATACTTGCACCTTACATGCAATGTCAGATG AAGTTTTCAAAAGGCTCCACAAGTTCAATGACATCA AATCCTTGGACTTCAATATTTCTTAAAGAAAATAAAA AGGGATCAATTAAATGCTCTAGTAAGTTCAGAGTAT GTGCTTCTCTCCAATCTGATAATAGCACAGTAAACA GGGTGGAGCAGCTACTCAACTTGGATGTCACTCCAT ACACTGACAAGATAATTGCAGAGTACATTTGGATTG GAGGATCTGGCATTGATGTTCGTAGCAAATCAAGGA CAATCTCTAAACCTGTTGAGCACCCATCTGAGCTTCC CAAGTGGAATTATGATGGCTCAAGCACTGGACAAG CGCCAGGAGAGGACAGTGAAGTAATCTTATACCCTC AAGCAATTTTCAAGGATCCATTCCGTGGTGGTAATA ATATCCTTGTAATCTGTGACACATACACACCAGCAG GCGAACCCATCCCCACTAATAAAAGATACAGGGCTG CACAGATCTTTAGCGACCCAAAGGTTGTTTCTGAGA TTCCATGGTTTGGAATAGAGCAGGAATACACGTTGC TCCAACAAAATGTTAAATGGCCTTTGGGATGGCCTG TGGGAGCCTATCCTGGTCCTCAGGGTCCATACTATT GTGGTGCTGGTGCTGACAAATCTTTTGGACGTGACA TATCTGATGCTCATTACAAAGCTTGCTTGTATGCTGG CATCAACATTAGTGGCACAAATGGGAAGTTATGCC TGGCCAGTGGGAATTCCAAGTTGGCCCAAGTGTTGG TATTGAAGCTGGAGATCATATCTGGTGTGCGAGATA TATTCTTGAGAGAATTACTGAACAAGCTGGTGTGGT TCTGACTCTTGATCCAAAGCCTATTGAGGGTGATTG GAACGGTGCAGGTTGCCATACCAATTACAGTACAAA GACCATGAGAGAAGATGGTGGTTATGAAGCAATTA AGAAGGCAATTTTGAATCTTTCATTACGCCACAAGG ACCATATCAGTGCATATGGAGAAGGAAATGAACGA AGGTTGACAGGGAAGCACGAGACCGCCAGCATCGA CACATTCTCTTGGGGTGTTGCCAATCGTGGTTGCTCT ATCCGTGTGGGTCGTGACACGGAAAAGGCAGGAAA AGGTTATCTGGAAGATAGACGGCCTGCCTCAAACAT GGACCCATACGTGGTAACAGGTTTGCTCGCAGAAAC TACAATACTTTGGGAGCCAACACTTGAGGCTGAGGC ACTCGCAGCCCAAAAACTCGCTCTTAATGTGTAATTC |

TABLE 1-continued

Glutamine synthetase gene sequences isolated from various weed species

| SEQ ID NO | SPECIES | TYPE | LENGTH | SEQ |
|---|---|---|---|---|
| | | | | ATTCATAAATCGTACCAGAGTATCGCATATTCATGAA
CGAGGGAACTCTTTCACGTGCCCAGAATTCGCTTATT
TTTAGTTTTTAGTATCCTGGGTATGTGAGTGTTTTCA
TTCATGACATTTGCTTCCGATCATTGTTTGTTTTGGG
AATTCTAGAGAATAATTTGTAACTGTTGCCTTTATTT
TTGCTCTTATGAAGCTCAAGCTCAGTATTAGTTATAT
TCCAGTTTAAGGAATGAACTTCAAAATCGTTTGTTAC
TCATCTTCAACTCCATTGAATACAAACTTAATAACTT
ATGTCTTAGTTTGCTAC |
| 2 | Amaranthus palmeri | gDNAContig | 8486 | CATGTAAAAATCAATGTGAACACAAAACCCGATTTT
GAACCTACCCGAAACACCTGACCCTAAATCAACTCG
ATGACCCGAATGAACATCTGTAGGTGGGAGTAACA
ATCACGTTTTATGAGTCCATTTCCCCTTTAGGATATT
GTTTTCTCTATTTGGCTTTCCCAAAAAGTCAATGCTT
GGCTTTAGATTGATACAAACAATGAGCATGCATGTG
AGTGACAGAATGAGTAGACACAAACAAGAACCCTA
ATTAAATATCTAAATCATTACATACAATTTGATTTCC
ATTAATTTAGTCCAGAGATTCTTTTGCATTCTCCAAA
TCTTGTTCAGATTGTTTATTCACCACTCAATTTCAGCA
TCCCTATCCTCTATGGAAGAGCCACACTTCATTTTCA
ACCATTATTCCACACTCCACACTACCCATTTCATTCTG
CTTACTCTCCTTCCTTCTTTCTCACTCCTTTATCTCTCT
ATATTCATCTTTCTCTCTCAGTTTGTTCACGACGCCG
ACCACCCTTTTCCGATCCCAGGTTCTGCTGTTTATTTA
GCTTTTTTTGGTTATGTTTGCAATTGACTGTTGTGCT
GCTTGTAGTATCAGATTTGTGGAATTATCAGTGTTTT
GTGTTTGTGTGTTGAAACATGGCAAATGGGTTTGCA
TTGTGTTAATTTTTTCTTACTCGGATTGACATTGACC
GATCAACTCATTACCGCTAAAACACCCTTTTTTTTAAT
GGTGGAATGGCATTTGTTAAATGTTAGTCGTTTTGG
TATAGTAGCTTCAGATTAAGACTGCATAATGTTTACT
GGAGCTGTATTAAGATGCTATATTAGGGTTTTTGCT
ACACTTGAACATGGGTAAATGGTACCCAATTGGTTG
AAACTTGAAACTAGGATATTTCAATTGTGATTTTTCC
CTTTGTTTGACTTTCCCCGGATGCTTTGTGGGTTGAT
ATTGGCGTGGTAATGGGAAGATCAATTGTTTTAGG
ATCAGGATTTAGGTATTCATTACCTCTAAACTCCCTT
TATGGTATGATTTGTCGCCTTCCTTCCCTTTCCAGAC
CCTGATCATAGTTTCCTTATGAGTGGGATACACTAGT
CAAGATGATCATGATGATGATGATAATTTTAGCTATT
CCTTGTGCTAGAGTCATTGATCAGTGTTACAAATTTC
CCAAACAAATTTGATGAGATGGAAGATAATTATTAA
AGCTACATTTTGTCGGAATACTATTGAAATTAATCAC
TTGTTAGAATATGTAAGTAGGTTATTACATTACTAAT
CACTTGTTAATGTCATTTTAATATGGAGGGAGTATG
GTTTTGTGGTTTTCCTAGCTAACAATCTATACCTGCG
GTCCTGCTGGCTATTTCTTTCCAGGCTCATGTTAGTA
TAGTGTATAAGTGGCCCCAACTTATCAGAAAGATGG
ATTTTGGCATTAACTATGTGACTATGTCCAAGTATAT
TGAACACTTTTATTTCTAGTTTCATTTATCTCCTGTAC
TTATTTGAGACCTGCTCTTGTGCTTCATATAAAAAAT
TACACAAAGGTTACAAAACACTGTTGGACTAAAACA
TAAGGAACTCGCCTTTACAACAATTGAAATTTTCTCA
TCTCATTCATATAGTGAGCTACTATTTGTGCGCGAGC
GATTACCGAATAGTGATTACATCATCTCTTTTGCCTA
TGTGTTTGTATTACTTGCATTTGCATACTCATGTCAT
GTACATGTGGATTTTCATGCTCAAACTTGAATACTTT
ATGAAGACATATCTGAAACACATGTGCATTTGTATT
ACCACATTTTTTATCCAAAATGATATTCCAAATGTA
TTGTATGTCGGGGTGCCCAGCATTTAATCCAAAAGT
TTCATAAACCTTGAGTGACCGAGATGCAAATCTGTG
GCAATCTGATCTAAAGGTTTCATAAATCCTAGAATTC
AAAGCAGACATATCTGAAACACATAAATTAACGTGT
TATGCCCATGTACTCGAAAATGTTTCCTGGAAACTG
AGATTGGTTTTTCAACATAAGTTGACTCTTGACCATT
GTGTGTTTGGTTAGCAATCTACCTGAGTAACCCACAT
ATGTAAAACCCTAACATATTTTATTTGTGTTGTAGGT
AAAAGTGACCAAACATGGCACAAATACTTGCACCTT
ACATGCAATGTCAGATGAAGTTTTCAAAAGGCTCCA
CAAGTTCAATGACATCAAATCCTTGGACTTCAATATT
TCTTAAAGAAAATAAAAAGGGATCAATTAAATGCTC
TAGTAAGTTCAGAGTATGTGCTTCTCTCCAATCTGAT
AATAGCACAGTAAACAGGGTGGAGCAGCTACTCAA |

TABLE 1-continued

Glutamine synthetase gene sequences isolated from various weed species

| SEQ ID NO | SPECIES | TYPE | LENGTH | SEQ |
|---|---|---|---|---|

CTTGGATGTCACTCCATACACTGACAAGATAATTGC
AGAGTACATTTGGTATATGGTTTTCCTTTCTATAGGC
CAGATGTCACATTAATTTTTTTTAGCTAATGTTTGTG
CTACTTTTAGTTTTTTCTCATCTGTAGATAAGACATTC
TTGGTGGTTTCTACTTTCAATCTGATTATAGAACTAA
TTGATCTACGATTGTTCTTTGGAACAGGATTGGAGG
ATCTGGTATTGATGTCCGTAGCAAATCAAGGGTACA
ATAACACTGATGCTGTCGATTTATTGTTAAACCAGCA
TTTAGATGTTAAGTTTACTTCATTTTTTCCCTGACCGA
TGTTTCTTAATATACCAGACAATCTCTAAACCTGTTG
AGCACCCATCTGAGCTTCCCAAGTGGAATTATGATG
GCTCAAGCACTGGACAAGCGCCAGGAGAGGACAGT
GAAGTAATCTTATAGTAAGATCTTGGGCAGCTATA
AACCTTTATTACTTTGCTCAATTATTGTTGTCCTTGTT
TTTGCTTGACTATCTTTTGGGGCTTGAGAGTTCTTGT
CACTGAACTAACTCAAAAAGCTTAAGCTTTCATTTGA
GTCGATTCCTTGACATGGTATGGGAAGGTTAGCTTA
CGGGTTTGAATCTCATTTACCCTCCGGGAATTATTAT
TACTAAGTAAATGTGTCGTGTCCACACTTCTAGTTAG
GGCTTTCGTGTGAGGGGGCGTAGTAGGACCTCAAC
CATCAACTTAAGATTTATTTGAGTTGATTCCTAGAAA
ATTCTTGTCACTCATTAATTCGTAATCATGTCATTCAT
ATGCAGCCCTCAAGCAATTTTCAAGGATCCATTCCGT
GGTGGTAATAATATCCTTGTGAGTCATATTCTTTCTG
ACTGTTGTGAAACTCAATATTTATTCCAAAATTATGA
TGTTACCTCAATTGTTGAGATTAGAATTTTAATTATG
CATTGCCATGTAAATTTAGGTAATCTGTGACACATAC
ACACCAGCAGGCGAACCCATCCCCACTAATAAAAGA
TACAGGGCTGCACAGATCTTTAGCGACCCAAAGGTT
GTTTCTGAGATTCCATGGTAAGAAATTCCCATCATTG
ACAATATTTTGTTCCTAATCATATTTCCTAATTTAACA
CTCTCCACTGCAAGGGTGAACTTTATAGAAAGTTGA
CCCACTATCTGAGAAATGACAAATTAAAAACTGATT
TCTCTAGTTTTCTAATAAAAGACAATGCATAAATTAT
GTGATGGATACCACTAAGGGAATAACCTCACCAAAG
TTCACTTAAATTTGAAGGTTAAATTGTGGGATGTAC
AATCTAAACTCTCAATGTTTCTTTTGGATTCTAGGGA
ATGCTTATCCAAGCTTAAAACTGATCTTTTTGAATTTT
GAGTAAGATTGAACTCCGAATTCATTCAAAATTTTCA
AGAGCTCGTCAATATTACAACTCAAGCTTTGACAAA
ATCAAAACAATCATTCGTGTAAACACAATGAATTTGT
TTAAGGTGTTCAACTTTGTATTCTCTAAATAATGCAT
ACAACCTAGGGCCCCAGGCTACTTCAACGAGAACAT
ACCTCTAGTCCGACTCTTACTAGGAATTTCCTAAATA
ATGCTAAATCAAATATCTTCTGGATTGATTTAGCTGC
AAGTATCAAACAATATATTACTATTACTCGAATTAAA
AAGTAATCCTACCCTTATCCGGAGTGTAAAAATATCC
GGCTATCCTGTAAGAAAACCATAACCTAAACCTACG
TCTACTAGGATATGGTCAAACTATGAAGAAGCTTCC
AAGGATATTTGACATGGATAGAACTTTGACTTTTAA
CTCATACAAGCCAACATCACTTTGCAAACAAGTGAA
TAAATGATCCAAGCTGGGACTACGGAGAGGACAAA
ATGCGCACTTGTTCACATTAGAAAAATTACTAACAG
GAAGTATTCATTTGAACAAGCTAGGACTTCAAGTAA
TGCCTTTGATCTTGTGTCAATGGTTAGCAGTCGTAAT
ACAGTATGTCACACTTGTAATTAACATAACAAATCTG
TTGTTTTAAATATGACGGTTTGAATACCCATGTTCTA
CGGGAGGCATTTCACTATAAAGGTCAACCGTTTTTG
CCTAGTTTGGAGCTTGACAATTGCAAAAGTAATTCA
GGGGTCTGCTTTTCTAGAATTCTGGATCATTATGAGT
CTCTTCTGCTCTTTGTTTTCGCCTTTCTTTTTTCACTCT
CTAGTCTCTACTTTTGGGTTTATTCTTTATATTATACT
TTTGTAGGTTTGGAATAGAGCAGGAATACACTTTGC
TCCAACAAAATGTTAAATGGCCTTTGGGATGGCCTG
TGGGAGCATATCCTGGTCCTCAGGTGTGTTAATTCC
CCATATTATCAACAGTTTCTTTGAAGATAATGCTTTG
TTTCTGTTATATAATATGATTTTTTTGATATGTCTAGG
GTCCATACTATTGTGGTGCTGGTGCTGACAAGTCTTT
TGGACGTGACATATCTGATGCTCATTACAAAGCTTG
CTTGTATGCTGGCATCAACATTAGTGGCACAAATGG
GGAAGTTATGCCTGGCCAGGTGTCCTCTCGTATCAT
TCTTATGTCTTATTGCTATTTAATATGTCTTTGAAGTT
GGTTATGAATAGCTACATCTGCTTACACCTGCAGTG
GGAATTCCAAGTTGGTCCAAGTGTTGGCATTGAAGC

TABLE 1-continued

Glutamine synthetase gene sequences isolated from various weed species

| SEQ ID NO | SPECIES | TYPE | LENGTH | SEQ |
|---|---|---|---|---|
| | | | | TGGAGATCATATCTGGTGTGCTAGATATATTCTTGA |
| | | | | GGTATTCTCCTGAAATTTGTATGTTTGCCCCTTTCAA |
| | | | | GTTATATTGTGGCAACTTTGAGTACATTCGAATGATC |
| | | | | AGGAATTCAGTCTTAGTGGTTAATTTTATAATTTTTA |
| | | | | CTAAGAGAACTGATAAATTAATCGACCTGACATTGA |
| | | | | AATTGTGCGTGATTCTCTGATCAAATGGGGACCACA |
| | | | | TTATGATAGAAATAATATGCATTATTATGACCCATAT |
| | | | | TTAGTCTACAATTGATTCAATCAAAAATCCTTATGGA |
| | | | | CCAGAAAAAGAAATTGTAATAATGATTCTCTAAAAA |
| | | | | TTTAGTTGAAATGTTGAATATAGGATCAAGCGTGAT |
| | | | | CCAAACCCAATCAAGATGGTATAAGGTGTCTTATCA |
| | | | | TCTATGTTTGTGAGAAAATGAGTTGTATCAGATTAAT |
| | | | | GGGAAACAACGGATGGAAGTTGATCACTTTTAGGC |
| | | | | ACATAAACAACAAACTTTCTTATATAATGTATATACT |
| | | | | CCTTCGGATGCGTAATTTTATTCAATCAAGCTGTTCA |
| | | | | ACAAGATTAAGCTACATGTCCTTTTGTTTTGTATGGG |
| | | | | ATGAACCAGAAAACTCTCATCTTTTTATGACCCTCAC |
| | | | | AAACCATTAACAATGTCTATTTATAGAGCATGTGTG |
| | | | | AATCTTAGGGCCTAGGGGTGTTAACGAGCTAAACCA |
| | | | | AGCCAAGTCGGGCTAGTGTGAGTGCTCAACTTGACT |
| | | | | TCATGTTTTTCAAACTCAAGCTAAATATTTGGATGTT |
| | | | | TTAGCTCAAAATTTAAGCTTCAAATCTCTATTTGGTG |
| | | | | TGATACTTTATATATATTAAGAGTTAAAAAGTTTCAC |
| | | | | TAACTACATATTAGAATATGCATTCGTATTGTATAAA |
| | | | | ACTTTAATAAGATTTTAAAATCTATTTAAAAACGATT |
| | | | | CTAATTCTCAAAACGAATATTGATAAAACCATTTTGA |
| | | | | GTATATTCACGAGCATATCAAGCTGAATGAGTTGGT |
| | | | | TTGCCTCTTAATCTTAGTTTCTTAAATGCTCGATAAG |
| | | | | CACCGAGGCACACAAGGTCCTCGGAGCCTAGGCGC |
| | | | | ATATCACAAGGCAAAATGCGAGTTTTTTGTAGGCA |
| | | | | AGGAGCAAATCTTCACTAAAAAAATATTAAATATCA |
| | | | | AATTTAAAACATAAATATACTTATATTCATATTATAA |
| | | | | TAGCAACAAGCTTGAAAATATTCGTTATCATTGTTGT |
| | | | | AAACACTAATTTAGCATATAAGTGATATGTTTGAAA |
| | | | | ATGTGAAAATACCCAGTTATATTCTTCTTCTTCATGT |
| | | | | GGTTGTCTAGCCTATTTATTATGCAAGCAATAATTTC |
| | | | | TCGAACTTCATATTCAAGTGAATTTGGGTTTCTATGT |
| | | | | TTTATTTATTTTCAAACAAACAAGTTTAAGTTAATGT |
| | | | | CCAAGCCCAACAAGGAGGTGTATTGAGCGCACATG |
| | | | | GCCCGAAACGCGTCGAGGCACACCAAGATGCGCGC |
| | | | | CTCTTATAGTGGTTTTTGCCTCACCTTGCTAAGGCGT |
| | | | | CTTCGGCCGTGCAAAGCAATGCACACTTTTTAAAACT |
| | | | | AAGCTCTTGATAATCTGAGTTGTGCTCAAATAGTTTG |
| | | | | CAAATCGTGTGGGATCATAAATACCCCTCCATTAAG |
| | | | | CAGTAGAGATTCACAATTTCATTTCATTTGCGGTGTA |
| | | | | TCCTCAAATCGCTGCACCTGTAAAGGCAGCTGAACC |
| | | | | AAGATCTCAGTTTTTTATTGACTGTCTAGTCTGTAGA |
| | | | | AAAATTAAGAGATATCACCATTCAAGCTATTTTAATT |
| | | | | GAATTTAACAAGCTTTCTCTCCTTCAAACAGAGAATT |
| | | | | ACTGAACAAGCTGGTGTGGTTCTGACTCTTGATCCA |
| | | | | AAGCCTATTGAGGTACTGCCTTGTCCTTTTGTATTTC |
| | | | | TTATGAGCAGCTGTCTTTTCTAAAGAACCAGACTGA |
| | | | | ATTCCTCTCCAATATCTGCTTTTTTCAACAGGGTGAT |
| | | | | TGGAATGGTGCAGGTTGTCATACAAATTACAGGTAT |
| | | | | CTCGAATGTTTTAAATATTTTATACTGGTTATAATAC |
| | | | | ACGTAGCCCCTTGAACAGGATATATTACTCGAAATG |
| | | | | GTATTAAATTTGTAATTCATGGCAAACCACACGTCAA |
| | | | | TTTATTTTGTAAATGACAAATACTTCTTTTAGCATTAT |
| | | | | GGCATATCCATCTTAATGCAGCACAGTACACTATTG |
| | | | | AATTAGCATTCCAAAACTTCGAATATCGCCTGGCTGT |
| | | | | CTTAAGTACCCTTATATAGACATTTAAATCTATACTT |
| | | | | GTTACTGTAATTGCTAGTGTCTATGGAATTCACTATA |
| | | | | CTTCACATAGCTGAGTTGAAGTTGATGTTAGTGTCT |
| | | | | GTGATTTTTGTAGTACAAAGACCATGAGAGAAGATG |
| | | | | GTGGTTATGAAGCAATTAAGAAGGCAATTTTGAATC |
| | | | | TATCATTACGCCACAAGGACCATATCAGTGCATATG |
| | | | | GAGAAGGAAATGAACGAAGATTGACAGGGAAGCA |
| | | | | CGAGACCGCCAGCATCGACACTTTCTCTTGGGTATA |
| | | | | CAGATATATATGCCTTTCTTGACGTCATGTTGAATA |
| | | | | TATTATTTTGCATATTATCTAACAAAAATATGATTTTT |
| | | | | TTTGTAACTTTCAGGGTGTTGCCAATCGTGGTTGCTC |
| | | | | TATCCGTGTGGGTCGTGACACGGAAAAGGCAGGAA |
| | | | | AAGGTAATAGTATCCTCTTGGACCTTGGTTAAAGAC |
| | | | | TATGACTACTGATTGGATGTTCTTTTTGTTTGCATTTT |

TABLE 1-continued

Glutamine synthetase gene sequences isolated from various weed species

| SEQ ID NO | SPECIES | TYPE | LENGTH | SEQ |
|---|---|---|---|---|
| | | | | GCTCCCCGGATTTAGAAATAACTCTTTCTCCCATTTC<br>CGTGCTCTGCAGTGAGTAACAACCAAATAGAATTCA<br>CTCCTTCCGTTTTTCTCAATTCACCGCACCTTCTATTT<br>TTGTCTATCCCCACGAAACTGCCCCATTACTATTTTC<br>GGACATGACTCACTACTTTAACACATCTTTACTCTCG<br>ATATTCTCTCTCTTATTTGCAAATGACCCCACCATTAA<br>CCCATTCAACCCAACTTTTAATCGCCGTCCCATTCCC<br>ACTTGGGGCAAAATCACAAGGACAAAGGAGTACAA<br>ATCAATTGCAATCCTGGCTAGTTCTGATTTCCAATCT<br>CCGATTTCTCTGCAGGTTATCTAGAAGATAGGCGAC<br>CTGCCTCAAACATGGACCCATACGTGGTAACAGGTT<br>TGCTCGCCGAAACTACAATACTTTGGGAACCCACGC<br>TTGAGGCCGAGTCACTTGCAGCTCAAAAACTCGCTC<br>TTAATGTGTAATTCCAACCATAAAATGAACCAGAAT<br>ATCGCATATTCTTGAGCGAAGAAACTGTTTCATGTG<br>CCCAGAATTTGCTTGTTTTTAGTTTTTAGTATCCTGG<br>GACTGAGACTGGCACTGGGGCTCAAAAACCTTTGCT<br>TCTGGTAGTTTGTTTGGGAGTTAGAAGAGAAGAAT<br>AGTTTGTGATTGTTACTAATTTATGAAGCTCAAGCTC<br>AGCATTAGTTCTATTCCAGTTTAAGG |
| 3 | Amaranthus palmeri | gDNAContig | 6862 | AGCTGTATTAAGATGCTATATTAGGGTTTTTGCTACA<br>CTTGAACATGGGTAAATGGTACCCAATTGGTTGAAA<br>CTTGAAACTAGGATATTTCAATTGTGATTTTTCCCTTT<br>GTTTGACTTTCCCCGGATGCTTTGTGGGTTGATATTG<br>GCGTGGTAATGGGGAAGATCAATTGTTTTAGGATCA<br>GGTTTTAGGTATTCATTACCTCTAAACTCCCTTTATG<br>GTATGATTTGTCGCCTTCCTTCCCTTTCCAGACCCTG<br>ATCATAGTTTCCTTATGAGTGGGATACACTAGTCAA<br>GATGATCATGATGATGATGATAATTTTAGCTATTCCT<br>TGTGCTAGAGTCATTGATCAGTGTTACAAATTTCCCA<br>AACAAATTTGATGAGATGGAAGATAATTATTAAAGC<br>TACATTTTGTCGGAATACTATTGAAATTAATCACTTG<br>TTAGAATATGTAAGTAGGTTATTACATTATTAGTCAC<br>TTGTTAATGTCATTTTAATATGGAGGGAGTATGGTTT<br>TGTGGTTTTCCTAGCTAACAATCTATACCTGCGGTCC<br>TGCTGGCTATTTCTTTCCAGGCTCATGTTAGTATAGT<br>GTATAAGTGGCCCCAACTTATCAGAAAGATGGATTT<br>TGGCATTAACTATGTGACTATGTCCAAGTATATTGAA<br>CACTTTTATTTCTAGTTTCATTTATCTCCTGTACTTATT<br>TGAGACCTGCTCTTGTGCTTCATATAAAAAATTACAC<br>AAAGGTTACAAAACACTGTTGGACTAAAACATAAGG<br>AACTCGCCTTTACAACAATTGAAATTTTCTCATCTCAT<br>TCATATAGTGAGCTACTATTTGTGCGCGAGCGATTA<br>CCGAATAGTGATTACATCATCTCTTTTGCCTATGTGT<br>TTGTATTACTTGCATTTGCATACTCATGTCATGTACA<br>TGTGGATTTTCATGCTCAAACTTGAATACTTTATGAA<br>GACATATCTGAAACACATGTGCATTTGTATTACCACA<br>TTTTTTTATCCAAAATGATATTCCAAATGTATTGTATG<br>TCGGGGTGCCCAGCATTTAATCCAAAAGTTTCATAA<br>ACCTTGAGTGACCGAGATGCAAATCTGTGGCAATCT<br>GATCTAAAGGTTTCATAAATCCTAGAATTCAAAGCA<br>GACATATCTGAAACACATAAATTAACGTGTTATGCC<br>CATGTACTCGAAAATGTTTCCTGGAAACTGAGATTG<br>GTTTTTTAACATAAGTTGACTCTTGACCATTGTGTGT<br>TTGGTTAGCAATCTACCTGAGTAACTCACATATGTAA<br>TACCCTAACATATTTTATTTGTGTTGTAGGTAAAAGT<br>GACCAAACATGGCACAAATACTTGCACCTTACATGC<br>AATGTCAGATGAAGTTTTCAAAAGGCTCCACAAGTT<br>CAATGACATCAAATCCTTGGACTTCAATATTTCTTAA<br>AGAAAATAAAAAGGGATCAATTAAATGCTCTAGTAA<br>GTTCAGAGTATGTGCTTCTCTCCAATCTGATAATAGC<br>ACAGTAAACAGGGTGGAGCAGCTACTCAACTTGGA<br>TGTCACTCCATACACTGACAAGATAATTGCAGAGTA<br>CATTTGGTATATGTTTTTCTTTGCTATATGATCAAAA<br>ATGTCGCTGACTCTAGGCCAGACGTAACATTAATTTT<br>TTTTAGCTAATGTTTGTGCTACTTTTGGTTTTTTCTCA<br>TCTGTAGATAAGACATTCTTGGTGGTTTCTACTTTCA<br>ATCTGATTATAGAACTAATTGATCTACGATTGTTCTT<br>TGGAACAGGATTGGAGGATCTGGTATTGATGTCCGT<br>AGCAAATCAAGGGTACAATAACACTGATGCTGTCGA<br>TTTATTGTTAAACCAGCATTTAGATGTTAAGTTTACT<br>CCATTTTTTCCCTGACCGATGTTTCTTAATATACCAGA<br>CAATCTCTAAACCTGTTGAGCACCCATCTGAGCTTCC |

TABLE 1-continued

Glutamine synthetase gene sequences isolated from various weed species

| SEQ ID NO | SPECIES | TYPE | LENGTH | SEQ |
|---|---|---|---|---|

CAAGTGGAATTATGATGGCTCAAGCACTGGACAAG
CGCCAGGAGAGGACAGTGAAGTAATCTTATAGTAA
GATCTTGGGGCAGCTATAAACCTTTATTACTTTGCTC
AATTATTGTTGTCCTTGTTTTTGCTTGACTATCTTTTG
AGGCTTGAGAGTTCTTGTCACTGAACTAACTCAAAA
AGCTTAAGCTTTCATTTGGTTCGATTCCTTGACATGG
TATCGGAAGGTTAGCTTACGGGTTTGAATCTCATTT
ACCCTCCGGTAATTATTATTACTAAGTATTTGTGTCG
TGTCCACACTTCTAGTTAGGGCTTTCGTGTGAGGGG
GCGTGGTAGGACCTCAACCATCAACTTAAGATTTGT
TTGAGTTGATTCCTAGACAATTCTTGTCACTCATTAA
TTCATAATCATGTCATTCATATGCAGCCCTCAAGCAA
TTTTCAAGGATCCATTCCGTGGTGGTAATAATATCCT
TGTGAGTCATATTCTATCTGACTGTTATGAAACTCAA
TATTTATTCCAAAATTATGATGTTACCTCAATTGTTG
AGATTAGAATTTTAATTATGCATTGCCATGTAAATTT
AGGTAATCTGTGACACATACACACCAGCAGGCGAAC
CCATCCCCACTAATAAAAGATACAGGGCTGCACAGA
TCTTTAGCGACCCAAAGGTTGTTTCTGAGATTCCATG
GTAAGAAATTCCCATCATTGACAATATTTTGTTCCTA
ATCATATTTCCTAATTTAACACTCTCCCTTGCAAGGG
TGAACTTTATAGAAAGTTGACCCACTATCTGAGAAA
TGACAAATTAAAAACTGATTTCTCTAGTTTTCTAATA
AAAGACAATGCATAAATTATGTGATGGATACCACTA
AGGGAATAACCTCACCAAAGTTCACTTAAATTTGAA
GGTTAAATTGTGGGATGTACAATCTAAACTCTCAAT
GTTTCTTTTGGATTCTAGGGAATGCTTATCCAAGCTT
AAAACTGATCTTTTTGAATTTTGAGTAAGATTGAACT
CCGAATTCATTCAAAATTTTCAAGAGCTCGTCAATAT
TACAACTCAAGCTTTGACAAAATCAAAACAATCATTC
GTGTAAACACAATGAATTTGTTTAAGGTGTTCAACTT
TGTATTCTCTAAATAATGCATACAACCTAGGGCCCCA
GGCTACTTCAACGAGAACATACCTCTAGTCCGACTCT
TACTAGGAATTTCCTAAATAATGCTAAATCAAATATC
TTCTGGATTGATTTAGCTGCAAGTATCAAACAATATA
TTACTATTACTCGAATTAAAAAGTAATCCTACCCTTA
TCCGGAGTGTAAAAATATCCGGCTATCCTGTAAGAA
AACCATAACCTAAACCTACGTCTACTAGGATATGGT
CAAACTATGAAGAAGCTTCCAAGGATATTTGACATG
GATAGAACTTTGACTTTTAACTCATACAAGCCAACAT
CACTTTGCAAACAAGTGAATAAATGATCCAAGCTGG
GACTACGGAGAGGACAAAATGCGCACTTGTTCACAT
TAGAAAAATTACTAACAGGAAGTATTCATTTGAACA
AGCTAGGACTTCAAGTAATGCCTTTGATCTTGTGTCA
ATGGTTAGCAGTCGTAATACAGTATGTCACACACTT
GTAATTAACATAACAAATCTGTTGTTTTAAATATGAC
GGTTTGAATACCCATGTTCTACGGGAGGCATTTCAC
TATAAAGGTCAACCGTTTTTGCCCAGTTTGGAGCTT
GACAATTGCAAAAGTAATTCAGGGGTCTGCTTTTCT
AGAATTCTAGATCATAAAAGCCTCTTTGATCTGTGTT
TTCTCTTTTTTTTTCCCTCTCTACTCTTCGATTTATTC
TGTTAATTTTACTTCTACAGGTTTGGAATAGAGCAG
GAATACACGTTGCTCCAACAAAATGTTAAATGGCCT
TTGGGATGGCCTGTGGGAGCCTATCCTGGTCCTCAG
GTGTGTTAATTCCCCATATTATCAACAGTTTCTTTGA
AGATAATGCTTTGTTTCTGTTATATAATATGATTTTTT
TGATATGTCTAGGGTCCATACTATTGTGGTGCTGGT
GCTGACAAGTCTTTTGGACGTGACATATCTGATGCT
CATTACAAAGCTTGCTTGTATGCTGGCATCAACATTA
GTGGCACAAATGGGGAAGTTATGCCTGGCCAGGTT
TCGTCTTGCATCACTCTCATGTGTTATTGTTAATTAAT
ATGTCTTTGAAGTTGGTTACGAATAGCTACCTCCACT
TGCCCCTGCAGTGGGAATTCCAAGTTGGCCCAAGTG
TTGGTATTGAAGCTGGAGATCATATCTGGTGTGCGA
GATATATTCTTGAGGTACTCTCCTGATAGTTTTATGT
TTGTCGATTTTGTGTTAAATTGTGGTAAACCATAAAG
TACATTTGTTTAATTAAAAATTTGGCCTTAGTGGTTA
AAATTATATAATTAACCTTCAAACTAATAAGTCAATA
GATTTGACATTGAAGTTGTGGCTGATCAAGATCAAA
CTAGGACCATATTATGATGGAAACAAAAACATAATT
TTGACCCATATTCGGTATGCGATTGATTCAATCAAGA
AACTTAATGGACTTTCGAAAGTAAATAAAATAATCC
TTCTTTATGAAGAAAATTTGAATACAGGTTTATAAGT
GATCCAAATTCAAGCCCAATCAATGGAAGAAAGCCT

TABLE 1-continued

Glutamine synthetase gene sequences isolated from various weed species

| SEQ ID NO | SPECIES | TYPE | LENGTH | SEQ |
|---|---|---|---|---|
| | | | | ATTACACTTCTAGGAACATAGACACGGCAGTTTTCTT<br>ATAGAATGTTATTGACTCATCGAGAGTTGCAATTAA<br>ACTTGGTTGTTCAACAAGATTAAGCTACATGTCTTTT<br>GGTTTTGTATGGGATGCACCGTAAATTCTGGTTTTTC<br>CTATGACCCTCACAAGCCAAGCCTATTGAGGGGATC<br>AGATCTCAGTTCTTTTAATGATTGTATACTCTGTAGA<br>AAAATTGAGGAGATATCACCATTTACAAGCTATTTTC<br>ATTGAATTTAACAAGTTTTCTCTCCTTCAAACAGAGA<br>ATTACTGAACAAGCTGGTGTGGTTTTGACTCTTGATC<br>CAAAGCCTATTGAGGTACCGCCTTGTGCTTTTGTATA<br>TGTAATGATCAGCTGTCTTTCCTGAAGAACCAGACT<br>GAATTCCTCTCCAATATCTGCCTTTTTCAACAGGGTG<br>ATTGGAATGGTGCAGGTTGCCATACAAATTACAGGT<br>ATCTCGAATGTTTTAAATATTTTATACTGGTTATAAT<br>ACACGTAGCCCTTGAACAGGATATATTACTCGAAAT<br>GGTATTAAATTTGTAATTCATGGCAAACCACACGTC<br>AATTTATTTTGTAAATAACAAATATCTCTTCTTTTAGC<br>TTCTTATGCATATTCCTTAGTGCAACAAATATCATTT<br>GCCTTTTGTTTTAGTACTAATATATGTTACTGATTTTG<br>TAAGACATTATGGGATATCCGTGTAAATGTAGCACA<br>GTATCTAATGAATCAGCATCCAAGTGTTCGAATTTTG<br>GTTAACTGCCTCAAATCTGATTTTTCTGTTGGCGCTC<br>AACCAAAATTGTAAAATGAATGATGTTCTCATGTAC<br>ACGCTAGCCTGTAGCTTCAGCCACAAGTTTGAACGA<br>GCTACCCATATTTTCTCACTGTACCTTTTTGATATAGA<br>TTTTATGCTCCGTATAACCAATATTTCTGAGATATGA<br>GATGAGGCCTATCTAGTGTGGGGTGGATAAAAAGA<br>TTTTCACCGCAATTCTTTTTAAAGCGTTAGTAACACT<br>AACATAGACCTTTTAAACTATTCTTGTAAGCGTAAGT<br>ACTGTAGTTGAGTTGAAACATTCCGAGAGCTTAATT<br>GTCTCATTTTGCCAACGCTAAGAAAATTGATGAGCA<br>AGGTTGTAATTTTTGTAGTACAAAGACCATGAGAGA<br>AGATGGTGGTTATGAAGCAATTAAGAAGGCAATTTT<br>GAATCTTTCATTACGCCACAAGGACCATATCAGTGC<br>ATATGGAGAAGGAAATGAACGAAGGTTGACAGGG<br>AAGCACGAGACCGCCAGCATTGACACATTCTCTTGG<br>GTATACTGATATATATGCCTATTCTTGACGTCATGTT<br>GAATATATTATTTTGCATATTATCTAACAAAAATATG<br>ATTTTTTTTGTAACTTTCAGGGTGTTGCCAATCGTGG<br>TTGCTCTATCCGTGTGGGTCGTGACACGGAAAAGGC<br>AGGAAAAGGTAATATTATTCTCTCGTTGGAAGACTA<br>TGACTGTCTCACATTGTCGTTGTCTGTAGTAAGTAAT<br>GTCCAAATATAAAATCATCATCATACCCAATATCCCG<br>CTCGAAAGCAGGGTTGGGTGAGGGAAGGTGACGG<br>ACAATCCATACCCGTAATCCCTTCACAGGGAGGACT<br>AGAACATACTACTCATTTACACATCTTGAATGAAGCA<br>GTCTCGTTTCATGGGGTGACATCATAATAGTCGGAT<br>ATAAAGCAATATTTATGATTTCCAAGGTTTGATTTCT<br>CTACAGGTTATCTGGAAGATAGACGGCCTGCCTCAA<br>ACATGGACCCATACGTGGTAACAGGTTTGCTCGCAG<br>AAACTACAATACTTTGGGAGCCAACACTTGAGGCTG<br>AGGCACTCGCAGCCCAAAAACTCGCCCTTAATGTGT<br>AATTCATTCATAAATCGTACCAGAGTATCGCATATTC<br>ATGAACGAGGGAACTCTTTCACGCGCCCAGAATTCG<br>CTTTTTTTTAGTTTTAGTATCCTGGGTATGTGAGTG<br>TTTTCATTTGTGACCTTTGCTTCTGATCATTGTTTGTT<br>TTGGGAGTTCAAGAGAAGAATAATTTGTAACAGTTG<br>CCTTCTTTATTTTTGCTCTTATGAAGCTCAAGCTCAGT<br>ATTAGTTATATTCCAGATTAAGGAATGAACTTCAAA<br>ATCCTTTGTTACTCATCTTCAACTCCATTGAATATACA<br>CTTATGTCCCGTTGG |
| 4 | Amaranthus rudis | cDNAContig | 1618 | GGGACAATCATACTCCTATAACAACTTTAATCATACA<br>CTCTCTCTTCTTTATCTCTCTATATTCTTCACTCTCTCT<br>CTAGTTAGTTGACGCCGCCGACCACCTTTTCCGAACC<br>CAGTGACCAATTATGGCACAGATACTTGCACCTTAC<br>ATGCAATGTCAGATGAAGTTTTCCAAAGGCTCGACT<br>AGTTCAATGACATTAAGTCCTTGGACTTCCATATTTC<br>TGAAAGAAAACCAAAAGAAATCGATTAAATGTTCTA<br>GTAAGTTCAGAGTATGTGCTTCTCTCAAGTCTGAAA<br>ACGGCACTGTAAACAGGGTGGAGCAGCTACTCAAC<br>TTGGATGTCACTCCATACACTGACAAGATAATTGCG<br>GAGTACATTTGGATTGGAGGATCTGGTATTGATGTC<br>CGTAGCAAATCAAGGACAATCTCTAAACCTGTTGAG |

TABLE 1-continued

Glutamine synthetase gene sequences isolated from various weed species

| SEQ ID NO | SPECIES | TYPE | LENGTH | SEQ |
|---|---|---|---|---|
| | | | | CACCCATCTGAGCTTCCCAAGTGGAATTATGATGGC |
| | | | | TCAAGCACTGGACAAGCGCCAGGAGAGGACAGTGA |
| | | | | AGTAATCTTATACCCTCAAGCAATTTTCAAGGATCCA |
| | | | | TTCCGTGGTGGTAATAATATCCTTGTAATCTGTGACA |
| | | | | CATACACCCCAGCAGGCGAACCTATTCCCACTAATA |
| | | | | AAAGATACAGGGCTGCACAGATATTCAGCGACCCA |
| | | | | AAGGTTGTATCTGAGGTTCCATGGTTTGGAATAGAG |
| | | | | CAGGAATACACTTTGCTCCAACAAAATGTTAAATGG |
| | | | | CCTTTGGGGTGGCCAGTGGGAGCTTATCCTGGTCCT |
| | | | | CAGGGTCCATACTACTGTGGTGCTGGTGCTGACAAG |
| | | | | TCTTTTGGACGTGACATATCTGATGCTCATTACAAAG |
| | | | | CTTGCTTGTATGCTGGCATCAACATTAGTGGCACAA |
| | | | | ATGGGGAAGTTATGCCTGGCCAGTGGGAATTCCAA |
| | | | | GTTGGCCCAAGTGTTGGTATTGAAGCTGGAGATCAT |
| | | | | ATCTGGTGTGCGAGATATATTCTTGAGAGAATTACT |
| | | | | GAACAAGCTGGTGTGGTTCTAACTCTTGATCCAAAG |
| | | | | CCTATTGAGGGTGATTGGAACGGTGCAGGTTGCCAT |
| | | | | ACAAATTACAGTACAAAGACCATGAGAGAAGATGG |
| | | | | TGGTTATGAAGCAATTAAGAAGGCAATTTTGAATCT |
| | | | | ATCATTACGCCACAAGGACCATATCAGTGCATATGG |
| | | | | AGAAGGAAATGAACGAAGATTGACAGGGAAGCAC |
| | | | | GAGACCGCCAGCATCGACACTTCTCTTGGGGTGTTG |
| | | | | CCAATCGTGGTTGCTCTATCCGTGTGGGTCGTGACA |
| | | | | CGGAAAAGGCAGGCAAAGGTTATCTGGAAGATAGG |
| | | | | CGGCCTGCCTCAAACATGGACCCATACGTGGTAACA |
| | | | | GGTTTGCTCGCAGAAACTACAATACTTTGGGAACCA |
| | | | | ACACTTGAGGCTGAGGCACTAGCAGCCCAAAAACTC |
| | | | | GCTCTTAATGTGTAATTCAATCATAATCGTGCCAGAA |
| | | | | TATCGCATATTCATGAACGAGGGAACTCTTTCACGT |
| | | | | GCCCAGAATTTGCTTATTTTTAGTTTTTAGTATCCTG |
| | | | | GGTATGTGAGTGTTTTCATTCATGACCTTTGCTTCTG |
| | | | | ATCATTGTTTGTTTTGGGAGTTCAAGAGAAGAATAA |
| | | | | TTTGTAACTGTTGCCTTCATTATTTTTGCT |
| 5 | Amaranthus rudis | cDNAContig | 1550 | GATTTCTTAATTGAAGTTCCCAAAAACAAATAACATA |
| | | | | CTCATCTTCCTCTTTCTCTTATTCATCCAATTTTATTCTT |
| | | | | CCCCAAAAAACATGTCTCTTCTTACAGATCTCATCAA |
| | | | | TCTTAACCTCTCTGACTCCACTGAGAAGATCATTGCT |
| | | | | GAATACATATGGATTGGTGGATCTGGTATGGACATG |
| | | | | AGAAGTAAAGCAAGAACACTTGATGAACCTGTGAG |
| | | | | TGATCCTAAAAAGCTTCCAAAATGGAATTATGATGG |
| | | | | ATCTAGCACTAATCAGGCTCCTGGTGAAGATAGTGA |
| | | | | AGTCATTCTATACCCACAAGCTATCTTTAGAGATCCA |
| | | | | TTCAGGAGGGGCAACAATATCCTTGTTATGTGTGAT |
| | | | | GCCTATACTCCACAAGGAGAGCCAATCCCAACCAAC |
| | | | | AAGAGACATAATGCTGAAAAGATATTCAGCCATCCA |
| | | | | GATGTTGTTGCCGAGGAACCATGGTACGGTATCGAA |
| | | | | CAGGAGTACACCTTGCTGCAAAAGGATGTTAACTGG |
| | | | | CCCCTTGGTGGCCTGTAGGGGGTTTCCCTGGTCCAC |
| | | | | AGGGCCCGTACTACTGTGGTGTTGGTGCTGATAAAG |
| | | | | CTTTTGGAAGGGACATTGTTGATTCACACTACAAGG |
| | | | | CTTGCCTCTATGCAGGAATCAACATTAGTGGAATCA |
| | | | | ATGGAGAAGTTATGCCCGGACAGTGGGAATTTCAA |
| | | | | GTCGGCCCGTCTGTTGGAATCTCTGCTGGAGACGAG |
| | | | | TTGTGGGTTGCTCGTTACATTTTGGAGAGGATTACC |
| | | | | GAGATTGCTGGAGTAGCTCTTTCTTTTGATCCGAAA |
| | | | | CCAATTCCAGGTGACTGGAATGGTGCTGGTGCTCAC |
| | | | | ACCAATTACAGCACCAAGTCGATGAGGGAAGATGG |
| | | | | GGGCTACGAGGTGATTAAGAAGGCCATCGAGAAGC |
| | | | | TCGGGTTGAGGCACAAAGAGCACATCTCTGCTTATG |
| | | | | GAGAAGGAAACGAACGTCGTCTCACTGGTAGACAC |
| | | | | GAAACCGCCAGCATTTCCACTTTCTTGTGGGGGGTA |
| | | | | GCCAACCGAGGAGCATCAGTTCGTGTTGGACGAGA |
| | | | | CACGGAGAAGAATGGCAAAGGATATTTTGAAGACA |
| | | | | GGAGGCCGGCTTCTAACATGGACCCATATGTCGTTA |
| | | | | CATCAATGATCGCAGAAACTACTCTTCTTTGGAAGCC |
| | | | | ATAGAGCGGCCACGAGCTTAATCAAGTAATTTGCTA |
| | | | | TTAACCAGCAGATCGATTCGCCTCTTGTGTTCTGCAT |
| | | | | CTGCCTATTCAAGTTGTTCGCCTTTTTGTTCATTTTTT |
| | | | | ACACTTCCATTCAGACCGATTATCATGTACAAACCGT |
| | | | | CGCTTGCTGTTTGCTGTGCGCGGGTAATAACATCAA |
| | | | | ATCCTTTGTCGCTTCGACAATATTGAAAATAACATTG |
| | | | | TACCCTTCTTATTTCTTCCTAGAAAATATGGAAAGTC |
| | | | | GGAGAGGATCATTTCTCTGCCATTATTGTGATGAAT |

TABLE 1-continued

Glutamine synthetase gene sequences isolated from various weed species

| SEQ ID NO | SPECIES | TYPE | LENGTH | SEQ |
|---|---|---|---|---|
| | | | | TTTTTTTGCATTGTTTGCAATTTATTGTCTTCAAATCT<br>TTGAGCCTTATCTCGATCATCTCGATCTTAATAAGCT<br>ATTAATCGTATGTGGGTGTTTTCAAGCA |
| 6 | Amaranthus rudis | gDNAContig | 2000 | TGTAATACCCTAACATATTTTTTTGTCGTTGGGAGA<br>AGTGACCAATTATGGCACAGATACTTGCACCTTACA<br>TGCAATGTCAGATGAAGTTCTCAAAAGGCTCAACAA<br>GTTCAATGACATCAAATCCTTGGACTTCAATATTTCT<br>TAAAGAAAATAAAAAGGGATCAATTAAATGCTCTAG<br>TAAGTTCAGAGTATGTGCTTCTCTCCAATCTGAAAAT<br>AGCACAATAAACAGGGTGGAGCAGCTACTCAACTT<br>GGATGTCACTCCATACACTGACAAGATAATTGCAGA<br>GTACATTTGGTATATGTTTTTTCTTTGTTATATGATCA<br>AAAGTGTTGATGACTTTAGGCCAGATGTCACATTAA<br>TTATTTCAAGCTAATGGTTGTACCAATATGAGTTTCT<br>GCTCATCTGTAGATAAGGCATTCTTGGTGTTTCCTAC<br>TTTCAATCTGATTATAGAACTAATTGATCTACGATTG<br>TGCTTTGGAACAGGATTGGAGGATCTGGTATTGACG<br>TCCGTAGCAAATCAAGGGTACAATAACACTGATGCT<br>GTTGATTGATTGTTAAACCAGCATTTAGATGCTGAG<br>CATACTTCATTTTTTCTCTGACCAATGTTTCTTAATAT<br>ACCAGACTATCTCTAAACCTGTTGAGCACCCATCTGA<br>GCTTCCCAAGTGGAATTATGATGGGTCAAGCACTGG<br>ACAAGCGCCAGGAGAGGATAGTGAAGTAATCTTAT<br>AGTAAGATTTTGGGGAAGCTACAAACCTTATTACAT<br>TTGCTTGATAATTATTGTCCTTGTTTTTGAGTGATTAT<br>CTTTTGAGGCTTGAGAGTTATTGTGACTGATCATTAA<br>TTCATTATTGTGTGTCATATTTTCATATACAGCCCTCA<br>AGCAATTTTCAAGGATCCATTCCGTGGTGGTAATAA<br>TATCCTTGTGAGTCATAGTCTCTGACTTAGTCATGAA<br>TCAGAATATTTATTCCAACGCTTTTGATGTTACCTCA<br>ATTGTTGAGAATATCAATATAATTTTGCTATGCAATG<br>TAAACTTAGGTAATCTGTGACACATACACCCCAGCA<br>GGCGAACCTATTCCCACTAATAAAAGATACAGGGCT<br>GCACAGATATTCAGCGACCCAAAGGTTGTATCTGAG<br>GTTCCATGGTAAGAAATTCCCATCATTGACAATATTT<br>TGGTCTTAATTGCATTTCATAGTTAACACTTTGCACT<br>GCAAGGATGAATTTTATAGAAAGTTGACACACTATG<br>AGAAATGACAAATGAAAAATTGATTTCTCTCGTCTTT<br>TTTTAAAAGACAATGCATAGACAAATGAAAAATTGA<br>TTTCTCTCGTCTTCTTCTAAAAGACAATGCATAGATT<br>ATGTGATGGGTACCACTAAGGGAATAACTTAACCAA<br>AGTTCACATAAATTTGAAGGGTAAATTGTGGGATGT<br>ACAATCTAATCTCTCAATGGTTCTTCTGGTGTCTAGG<br>GTTAAAACTAATCTTTTTGAGTAAGATAAGATTGAA<br>CTCTCCGAATTCATTAAAAATTTTCAAGAACTCGTCA<br>ATGTTACAACTCAAGGTTGGACAAAATCAACACAAT<br>CATTCGTGTAAACACAGCGAATTTGCTTAAGGTGTT<br>CAACTTTGTATTCTCTAAATAATGCATACAATCTAGG<br>GCCCTCGGCTACTTCGACGAGAACATACCTCTAGTA<br>TGACTCTTATTAGGATTTTCCTGAATATTGCTAAATC<br>AAATGTCTTTTGATTTAAAAGTAATCCTACCCTTATCT<br>GGAGTGTAAAAATATCCGGCAATCCAACAAGAAAA<br>CCACAACCTAAACCTACTTCTACTAGGATATGGTCAA<br>ACGATGAAGAAGCTTCCAAGGACATTTGACATGGAT<br>AGAACTTTGAGTATTAACTCATGCAATCCAAGATCA<br>ATTTGCAAACAAGTGAATAAAGGATCCAAGTTGGG<br>ACTTAGGAGAGGACAAAATGCACACTTGTCCACCTT<br>AGAGAAATTACTAACAGGAAATATTTCATT |
| 7 | Amaranthus rudis | gDNAContig | 208 | TGCAGGGGGTAGCCAACCGAGGAGCATCGGTTCGT<br>GTTGGACGAGACACGGAGAAGAATGGCAAAGGAT<br>ATTTTGAAGACAGGAGGCCGGCTTCTAACATGGACC<br>CATATGTCGTTACATCAATGATCGCAGAAACTACTCT<br>TCTTTGGAAGCCATAGAGCGGCCACGAGCTTAATCA<br>AGTAATTTGCTATTAACCAGCAGATCGATT |
| 8 | Ambrosia trifida | cDNAContig | 1723 | TTTTCCCTTTTTTATTATATTTATATTTATTTTTATATT<br>TATAAACAACCTTTTATATTTTATTTGTACCCATTTTA<br>CAACTTCCATTTTTCTCCCGCCACATAACCACTTTCCG<br>GCCACTTCTTTGGTGAAAATGGCACAATGTTTGGCG<br>CCTTCGGTGCAATGGCAGATGAGGTTAACAAGGAG<br>TTCAATGGAAACAAGCTCTATGACCTCCAAAATGTG<br>GAACTCTTTTCTTTGAAGCAGAGCAAGAAAGGCGC |

TABLE 1-continued

Glutamine synthetase gene sequences isolated from various weed species

| SEQ ID NO | SPECIES | TYPE | LENGTH | SEQ |
|---|---|---|---|---|
| | | | | GCTCAAAACGTCCACAAAGTTTAGAATATGCGCTTC GTCAAATGGAACCATTAACAGGATGGAAGACCTACT AAACTTGGATGTATCGCCTTACACCGATAAGATCATT GCTGAATACATTTGGATTGGGGGTTCTGGGACAGAT GTGCGCAGCAAATCAAGGACAATCTCGAAAGCGGT TGAGCATCCTTCCGAGCTTCCAAAGTGGAACTATGA TGGATCAAGTACTGGACAAGCACCAGGAGAAGATA GTGAAGTTATCTTATACCCCCAGGCGATCTTTAAGG ATCCTTTCCGTGGTGGGAACAACATACTGGTCATAT GTGATACATACACACCACAAGGCGAGCCTATCCCTA CAAACAAACGTGCTAAGGCTGCTGAGATTTTCAGTG ATCCTAAAGTTGTCGATCAAGTGCCCTGGTTTGGAA TTGAGCAAGAGTACACTTTGCTTCAGCCAAATGTGA ATTGGCCTTTGGGTTGGCCAACAGGAGGTTACCCTG GTCCACAGGGTCCATACTACTGTGGCGCTGGAGCAG ATAAGTCTTTCGGAAGAGACATATCGGATGCACATT ACAAGGCTTGCCTGTATGCTGGAATTAACATCAGTG GAACCAACGGCGAAGTTATGCCCGGACAGTGGGAA TTCCAAGTTGGTCCTAGTGTCGGAATTGAAGCTGGA GACCATATCTGGTGTGCTAGATACCTCCTTGAGAGA ATTACTGAGCAAGCCGGTGTTGTCCTAACACTTGAC CCTAAACCGATTGAGGGAGACTGGAATGGCGCAGG ATGCCACACTAACTACAGTACAAAGGCCATGAGAGA AGAAGGTGGATTTGAGGTGATTAAAAAGGCGATTT TGAACCTTTCTCTTCGCCACAAAGAACACATCAGTGC TTATGGTGAAGGAAACGAGAGAAGATTGACTGGGA AACACGAAACTGCCAGCATCAACCAATTTTCATGGG GAGTAGCTAACCGTGGTTGCTCAATCCGTGTGGGTC GTGACACTGAGAAGGCCGGCAAAGGTTACTTGGAA GACAGGCGTCCGGCATCAAACATGGACCCATATACA GTGACTGGATTACTTGCAGAAACAACCATCCTGTGG GAGCCTAGTCTTGAGGCCGAAGCACTTGCTGCGCAG AAGTTGGCATTGAATGTGTAGACTCAAGTCAACCCA TGATCTTCGAAAGCTCGGTGTTCTGTTTCTAGTTTGA TTTCTTCAACATCTTGTAAATAAAGGTCCCCACGCTT CATGTTCAACGCTATTTTTAGCGACTGGGTGCTTTTT TTTACAAATGGTTACTGGACAGTTTATGCACATTTTG ATGTGTCCTTGGTCACAACTGAGTCAACTTTATTCTC TTCTTGAATTGTAGAAAATACCTTCAGGTTTTGGGGT AATCTTTATATAAATATCGAGCATAAAACACCGGCTT GTTAAAAAAGAAAAAGTACCG |
| 9 | Ambrosia trifida | gDNAContig | 1000 | TATTATTATTAACTATGCAATATCCTAACTTTTTGTTT TTTACGATATAATTTATCGCTTTAACAGAGAATTACT GAGCAAGCTGGTGTTGTCCTAACACTTGACCCTAAA CCGATTGAGGTAATAGAAATCAATTTCAACCGTTTTA ATAAATTATTATTATTGTGGCGAATTGGACGTACAA AAAGATAATATTTTTTCCATTAGTTATGTTAGTGAGC TTATATCTAACTGCACAAATTCTTCTGGTTTGCGCTG ACAGGGAGACTGGAATGGCGCAGGATGCCACACTA ACTACAGGTACTCGCTTTCTCATACTAATCATCACCG TTTCGGAATAAAACCAAAATATTATCATGTTTTTCA ACCTTTATTACATTTAAATTTATTTTCTAAACAATTTG CAGTACAAAGGCCATGAGAGAAGACGGTGGATTTG AGGTGATTAAAAAGGCGATTTTGAACCTTTCTCTTCG CCACAAAGAACACATCAGTGCTTACGGTGAAGGAA ATGAGAAGATTGACTGGGAAACACGAAACTGCC AGCATCAACCAATTTTCATGGGTATATATAGAACACT TTCTACTCAATTTTATAAAAAAAAGTGCAAGGTTT CGTAAGTTTTTCTCAACTTGTATATTTTGCATTTGGCC AACTTTCAGGGAGTAGCTAACCGTGGTTGCTCAATC CGTGTGGGTCGTGACACTGAGAAGGCCGGCAAAGG TATTGAATTTTTTTTATTTATTTATTTTTTTTTTAATT CGAACATGCATAGTAAACACATAACCTGGTTTTATT GAAATAATTCTCCTTTGTTCTGATTTTTTTTCATGGTT AATTTGGATTACGCGTAGGTTACTTGGAAGACAGGC GTCCGGCATCAAACATGGACCCATATACAGTGACAG GATTACTTGCAGAAACCACCATCCTGTGGGAGCCCA CGCTCGAGGCTGAAGCACTCGCTGCTCAGAAGTTGG CATTGAATGTGTA |
| 10 | Ambrosia trifida | gDNAContig | 841 | TTAATGTGTAGGTTACTTGGAAGACAGGCGTCCGGC ATCAAACATGGACCCATATACAGTGACTGGATTACT TGCAGAAACCACCATCCTGTGGGAGCCTAGTCTTGA |

TABLE 1-continued

Glutamine synthetase gene sequences isolated from various weed species

| SEQ ID NO | SPECIES | TYPE | LENGTH | SEQ |
|---|---|---|---|---|
| | | | | GGCCGAAGCACTGGCTGCGCAGAAGCTGGCATTGA ATGTGTAGACTCAAGTCAACTTATGATCTTCGAAAG CTCGGTGTTCTGTTTCTAGTTTGATTTGTTCAACATCT TGTAAATAAAGGTCCCAAAAAGTCATCATATTCAAA GCTTTTTGTAGCAACTGGTTGTTTTTTATGAGATGA TTATTGGACAATTTATGCACATTTTGATGTGTCCTTG GTCCCAACTGAGTCAACTTTATTCTCTTCTTGAATTG TAGAAAATACCTTCAGGTTTTGGGGTAATCTTTATAT AAATATCGAGCATAAAACACCGGCTTGTTAACTTGA TTTGCCTCTGTGTTTTTAATTCAGCGGCGTGCATGT GGCTACTAAATTAGTAAGGATTAAAGTGTAGATGTT GTTAACTTATCATAAGGCTAGAACGTGTGAACACGA GCATGATCAATATAACAATGGCAAGGTCCAAACCCC TGTCACTTGGAAGTATGTTGGTTGGATTGGACGGTT ATAGGTGTTGAGCATATTATTTTGCCAACCCATCACG CGTATGATATTTTGGTCCCGACCCGTTTATAATACGT CAACATGTATGTGGTCATTCATGGTTCTATTTGATGT CAAAGTGCAATAGATGAGTATATTGTGAAACCATCC ACTTGTCATGCACTTAGAGTATGTTTGGATAAACTTA TTTGAGTCCAAAAGGACTTTTTGTTAAAAGGACTTAT TA |
| 11 | *Conyza canadensis* | cDNAContig | 1955 | CATGGATGGATTCTACATTGCCCGGTACTAACGTAC TCGTAGGAGCTCATGACAGCAAAAATGGGTTCCAGC ATCTTGGGGAGCTTGGAAAAGGGAATCAACCATAC CCACACCCCTATCTCTTTAGGAAAGGCCAATCTCCCC TCCTTTGTTTTCTCCTTTTATTTTTTATATATACTTTTT ATTAAAATAAAACATATACTATTTATTTATTTTTACAT CCATTTATCAAACAAACTTGCAACTTTCTTCTTTTCAT TCATTTTGCCGCTCTCAACCATCACTTTTCTCTACTTT CCGGCCGGTGAAAATGGCACAATGTTTGGCTCCTTC AGTACAATGGCAGATGAGGTTAACAAAAAATGGTA TGGAATCAAGCTCTATGTCATCCAAAATGTGGAACT CTTTGTCCTTGAAGCAAAGCAAGAAAGGAGCACTTA AGAACGCCACAAAATTCAGCATCTGTGCTTCAGCAA ATGGAACCATTAACAGGATGGAAGACCTACTAAACT TGGATGTCACTCCTTACACCAATAAGATCATTGCTGA ATACATTTGGATTGGAGGTTCTGGGACAGATGTGCG CAGCAAATCAAGGACACTCTCAAAACCAGTTGAGCA TCCTTCTGAGCTTCCAAAATGGAACTATGATGGATC AAGTACTGGACAAGCTCCAGGAGAAGATAGTGAAG TTATCTTATACCCCCAGGCAATCTTTAAGGATCCTTT CCGTGGTGGCAACAACATCTTGGTGATCTGTGACGC ATACACTCCGCAAGGCGAGCCTATCCCTACTAACAA ACGTGCTAAGGCTGCTGAGATTTTCAGTAATCCTAA AGTTGTATCGCAAGTGCCCTGGTTTGGAATTGAGCA AGAGTACACTTTGCTTCAGACAGATGTGAAGTGGCC TTTGGGTTGGCCTGTTGGAGGCTACCCTGGTCCTCA GGGTCCATACTACTGTGGTGCTGGAGCTGATAAGTC GTTTGGAAGAGATATATCGGATGCACATTACAAGGC CTGCCTGTATGCCGGAATTAACATCAGTGGGACCAA TGGAGAAGTTATGCCTGGACAGTGGGAATTTCAAGT TGGTCCTAGTGTGGGAATTGAAGCTGGAGACCATAT CTGGTGTGCTAGATACCTCCTTGAGAGAATTACTGA ACAAGCTGGTGTCGTGTTGACCCTTGACCCTAAGCC TATTGATGGAGACTGGAATGGAGCAGGATGCCACA CTAACTACAGTACATTGGCCATGAGAGAAGAAGGT GGGTTTGAAGTAATTAAAAAGGCGATTCTGAACTTG TCACTTCGCCACACTGAGCACATCAGTGCTTATGGA GAAGGCAATGAGAGAAGATTGACAGGGAAGCACG AAACTGCCAGCATTAACCAGTTTTCATGGGGTGTAG CAAATCGTGGTTGCTCAATCCGTGTGGGGCGTGACA CTGAGAGGGAAGGCAAAGGTTATTTGGAAGACAGA CGCCCGGCATCAAACATGGACCCGTACACCGTGACC GGATTACTCGCCGAAACAACCATCCTTTGGGAGCCT ACCCTTGAGGCTGAAGCACTTGCTGCCCAGAAGTTG GCATTGAATGTGTAAGACTCTCCCACGAGGTGATAT ACAACGAAGAAAGTGTCAACATGCATATTCATCCAT GTTCTTCGTAAACTCGGTTTCCTGTTTCTAGTTGATTT CTTGAAGATCTTGTAAATAAAGGTCATCACTGCTTCA AATTCAAGCTATTTTTAGCAAATGGGTGTTTTTCAGA TGATTATTGGACAGTTTATGCACAATTTGAAGTGTG CACAAGTGCACTTGACCCGGTCTGAGCAGACATTAT TTTCTCTTCTTGATTTAAAGAAAGCACCCTCACATTTT |

TABLE 1-continued

Glutamine synthetase gene sequences isolated from various weed species

| SEQ ID NO | SPECIES | TYPE | LENGTH | SEQ |
|---|---|---|---|---|
| | | | | GGGGGTATTTTCTCTTCATTTGATCATATCATATAAT TATCAATCGGTTTAGATGGGCTGCTGCTCCTTTTTT |
| 12 | Conyza canadensis | gDNAContig | 8676 | AAAAAAAAACTTTAACCTTTTTATGATCATGTGGTTT GAAAAGATGGGGCTTGAAAAGGTTCAAAATTTTAG ACCTTTCCAAAATTAGATAATTTATTATTTTTTCTTT TTAAGAATTAAGACATTTAATTTATTTAGAAAGCTAT AAGTGTTGAATCATCATGAAAATTGGCTTATAAAAA TATGTTAATATTAATATTATGAACCTTCAGAAAGATT TTATGCCATAAATATTTTTTATGTATGATGACTGATG ATATTGTGTAAATATCATAGATTGAAGACCCTTTCAA ACTTTAAAAACGGTGTTGATATCATCACTATTTAGAA AAAGAACTCTTTTTTTTTTAATGTGATTTATCTCAAA CTTTTTATTTAAATCGTTAACTACCTGATCAACAGGC GGATTTAAGTACAACTAATATCACACAAATGTCCAA TTAAAAAATCATCTCATAATCTATATGGTCCATAACA AAAGTTGATAACAACAAAGTTATTAAGCACCTGAAT ATACTTTTGTAAAAGGTTAGCTAGAAAAAGACAATA TATATCATACCATCAGACTTCTACTTGTGGAAATAAC GTTACCAAGCACATATTTCCATATGAATTACAACATG CTAACCTATATTAAATTACGTCTATGATCATTAACCC AACTCGATTTGGTATTGTGATGTGGTGATTATAACTT ACAACAAAGTACAATATGATAAAACTTGCTTTTTTA TATTATTATTATATCCAAAGTCTCTATATTAATCATAT TTAAAAAAGCTATTGACAAATCATAACAAACAACAC ATTTAAGTTCCATATATACTATCCATGAATCAATCAA TGAATCCAAAATTTTATTTTCATGATGATAAAAAGGA AAATAAGAAGAAAAAAAAAATAGTTTGAGGTTGTG AGAAAAAGCCTTATCTAGTTTCTCATCATATATGTTG AGTTGAGGCAAGGAATGAAAGGGAGAGGGGGGCT TTTGTTTTGTTATGATGACCTTAAAAAGAGACCAAAA ACCAATTTCCTCCACCCACACCCCTATCTCTTTAGGA AAGGCCAATCTCCCCTCCTTTGTTTTCTCCTTTTATTT TTTATATATACTTTTTATTAAAATAAAACATATACTAT TTATTTATTTTTACATCCATTTATCAAACAAACTTGCA ACTTTCTTCTTTTCATTCATTTTGCCGCTCTCAACCAT CACTTTTCTCTACTTTCCGGCCGGTACGTTCCTCCCTC CCTCCCTACATTACGTCATTGTTTTACTCATCACTATT TACACACAAACATATGACTTAATGTATACATATAATT TTGTACGGAACTTTTGCGATTTATCAGCCGCACACTC GAACTAAATTTTTTGATCGGAAATGTAGCCATTATAT ATATATATACACAGAGAGAGTATATTAAATATAT ATATATATACACAGAGAGATATCAAATATATGCATA GCATATATATGCGTGTGTGTGTATGTATATATAA CTTTGCTAGTGTTAATTACTCGAAATGACGATGTATA ACAAGTAGTAGTAAATCAGTAGAAACGGCGTCGTCC TATTAGTGTATGATGGCAACTACAAGTAGTAAATCA AGCCTAAAAGTTTGTTCAATATTAAAAATTAAAATAA AAACCAGGCCTGAAAATGTGGAAGGGTTGTTAGTG GTTAAATTAGTTGACCTGGATGGAGGTAGGTCAGAT GATAATAGTAGCTGTTGATCCAGGCCAAGTGGAGG ATCACCACACACTTGTATCTACTCTTGATTATTTTATT ATTTTTAAACTGCTACTTTTGATTAATCATTAATTTCA TATGAACATTTTAATATAAACATTTTTGCATCTGAAA ATGTTTTTCCATCTGCTAAGGATGAAAGGACCAAAA TGCCCTTCCATGCTGTTCAATGTTTTTCATAATTTAAA AGGTTATATATATATTTACTAATCTAGCTAGTGATTA TATATGTTGCCTTTTGAATCTGATGATCTTTTTTTGGC CAGCTACTTGAATATTGTTAAATAAATTTAGAAAAAT AAATATATGAATGATAAGTTTTAACTTTTAGGTAAAA GGATCTTGATAAGCAATAGCTGAAAGTCCGGAGCTA GAAAGGGCTTGGTATTGGTGGGACGTAATTGAAAA GATATACAAAATTAAACATTTATGATTTTTGCATCTG TTTGTATTTAGTGTGTCGAATGAAAAGTAAATGTAT AAAGAGTTGTGATAAATTTTTGGATCCGAACTGGTA CAGTGGTACATTACAGACACGGGCGAAAGCTTGGA GTGTTACTTTGATCCTAGATCTTAATAGACGAGATTC GTTACATATTAACTAATAATAGAAATGCAGCAATGC CCCCCTTGTTTATATTAAAGATTCATTTTTCTCATGTG TGAATTATGATTTTTTGATAAGACAAAAGTTGTTTAC TTGAAGTTGAATGATGTGGGTTCCTACTTGTTTTAAA AATGTGTAACCTCTTATCTAAAAACTCTGTACTTACG ATGATCACAAGAACCTGCATTGCTGACCATTTATCTT ATTTATTGATATTTTTGTGTCTGATAATATGGGTAGG |

TABLE 1-continued

Glutamine synthetase gene sequences isolated from various weed species

| SEQ ID NO | SPECIES | TYPE | LENGTH | SEQ |
|---|---|---|---|---|

TGAAAATGGCACAATGTTTGGCTCCTTCAGTACAAT
GGCAGATGAGGTTAACAAAAAATGGTATGGAATCA
AGCTCTATGTCATCCAAAATGTGGAACTCTTTGTCCT
TGAAGCAAAGCAAGAAAGGAGCACTTAAGAACGCC
ACAAAATTCAGCATCTGTGCTTCAGCAAATGGAACC
ATTAACAGGATGGAAGACCTACTAAACTTGGATGTC
ACTCCTTACACCAATAAGATCATTGCTGAATACATTT
GGTATATTTCATTCTTTGGATACACTTACCATACAAA
TTTCAGGCTTACTAACATATTAACAAAAGTTTGTTAC
GTTACTCTAAAGGCTTGTTCAATTCTTATTTAGTCCT
ATGCTTTCTACTTTCTGAAACAGGATTGGAGGTTCTG
GGACAGATGTGCGCAGCAAATCAAGGGTATGTTGG
GTTTTGATGCTTTGGTTTCTTTCAGTAATTATCTATAG
CTTCGCTAAAAGGAAAGATTGTAATATATGTTTCATT
ATATCTCTTGTAGACACTCTCAAAACCAGTTGAGCAT
CCTTCTGAGCTTCCAAAATGGAACTATGATGGATCA
AGTACTGGACAAGCTCCAGGAGAAGATAGTGAAGT
TATCTTATAGTAAGTTTTATTTCAAAAAATCACAAGT
CTCTTTACATGTGGTGATGTAACCAAAGTTGAAATTC
TGTATTTCAGCCCCCAGGCAATCTTTAAGGATCCTTT
CCGTGGTGGCAACAACATCTTGGTGAGTATAACGTT
GGTTCATTATACTATAAAGTCTTATGTATAAGCTGAG
AAACTCCCACCAACCAAAAGGTTGCAGTTTCGAGTT
CTATATGGACAAGTGCATGCGAATTTTTTCCCCTTGA
AAAATAAGGATACAAACTGAAATTGGACAACATATG
GCTTAAACTGATTCTGTACTGTTTTATAGGTGATCT
GTGACGCATACACTCCGCAAGGCGAGCCTATCCCTA
CTAACAAACGTGCTAAGGCTGCTGAGATTTTCAGTA
ATCCTAAAGTTGTATCGCAAGTGCCCTGGTAGGCTT
TTTGGGTGAAAATGTTCTTTTTTTCCCCCATAGAAC
TAAACTCTTAAATCCCTGTGTTTGATAATTGATACAT
ACATTAAACTTCTTGTCACATGAATAAGGGGCAGAT
AGGTCTGACTTTATTAGTCAACATACACCTCCCTTTT
ATGTGAACGGGGATACTCTACTAAAACAACAAAATA
AACAAATATTGCCTCTGTTTATTTCCCGGTAAAATTG
ATTTTAAATTTGGTTTTAGGTTTGGAATTGAGCAAGA
GTACACTTTGCTTCAGACAGATGTGAAGTGGCCTTT
GGGTTGGCCTGTTGGAGGCTACCCTGGTCCTCAGGT
ACTATTCATGATCTAACTTTTGTAAACTTCTACACCTT
CCTCATTTATAAATGGGATTTAATATCAGTTAAAGCT
AAAGGTGGCAAAATGAGTGGGCTAGATTGACCTGA
AAGACTTTTTTTAAACTAATTTTTTAGTTTTCCCTAT
TTATAATTAGTGTGCCAAATATTGTTATAATCATTTA
ATTTCAAAAATAGTTTATCTTTTTTTGAGTAACCATTA
TACTAAATTCACTCGTTTGAACCATTAGAGATAAAGC
ATAACTGAAGAGCGATTCTTTCATAAGCAATGAATG
AAATTTTCCACCCTTAAAAACAAGTGTTCTTATTAAA
TGTATTTCCTTTTGAAACTACAGGGTCCATACTACTG
TGGTGCTGGAGCTGATAAGTCGTTTGGAAGAGACA
TATCGGATGCACATTACAAGGCCTGCCTGTATGCCG
GAATTAACATCAGTGGGACCAATGGAGAAGTTATG
CCTGGACAGGTTTTTTTCTACTTCTTCACCTTATTAT
CTAATGAATTATGAAAAGAAGTATCATGGCAACAAT
TGTGTTTCACAGTGGGAATTTCAAGTTGGTCCTAGT
GTGGGAATTGAAGCTGGAGACCATATCTGGTGTGCT
AGATACCTCCTTGAGGTAAATCATCTTCAGCAATTTG
ATACAGTAACAACTTAATATATCCTACCGTGTTTTTT
AATCTATATCTAATTGTTTCTTGTGACTTTACTGTATT
TAACAGAGAATTACTGAACAAGCTGGTGTCGTGTTG
ACCCTTGACCCTAAGCCTATTGATGTAAGATATATCT
TGTTTGATGACTACTTTCCTTCAATTTTCCATCATAGT
GTTCAAATCTTGCTTAGGGAGAACATTTGAGCAACA
TGTAATGTCACTCTTTTGTAATTAGAGGTGGTTAGAT
AGGCATGTTGGTTAATGTGTCCAAATGTACAATTCTT
TGATGACACAAGCTTAGTTGACCATAAACACTTTTTT
CCTTTTGTTTTTCTTACAAAAAAGACGAACAAGATAA
TTGGCAATTCAAGCTATATTAAAATTCAAAAATTTAA
ACTTTTTGAGTAAAAAGGAATTTCAGGAGGTGTTAT
GAGCTAATAAAAGTATACATTTTAGGTCACTCATTTG
TGTCGATTTCATTTTAAGCTACTTCTATTGGGTTTAA
CAATGGGAGGCACAGAAAACGCCTCAGTTGACCCTT
TGATAACTAAACGGGTTGAATTTGCCACCTCTACCC
GCTCTGAATGATTCTGATTTTATTCTTAACTTACACA
ACGCTTGTTGATTTGAATTGGCAGGGAGACTGGAAT

TABLE 1-continued

Glutamine synthetase gene sequences isolated from various weed species

| SEQ ID NO | SPECIES | TYPE | LENGTH | SEQ |
|---|---|---|---|---|

GGAGCAGGATGCCACACTAACTACAGGTACTTGTTT
TCTTTACTCATAATAGACCTGCGTATTGTTTTTGAAA
CGCTCTAATGTGTGTGAACGTTGATTTCTTTCTTATA
TTAAAAATCCATTCACTTACTTTTGTGCTTTCAAATTT
CAGTACATTGGCCATGAGAGAAGAAGGTGGGTTTG
AAGTAATTAAAAAGGCGATTCTGAACTTGTCACTTC
GCCACACTGAGCACATCAGTGCTTATGGAGAAGGC
AATGAGAAGATTGACAGGGAAGCACGAAACTGC
CAGCATTAACCAGTTTTCATGGGTATAAAACATTTTA
TATCGAATTATAAGAGATAAACCAAAAAAAATAATT
TACACTTTCATAAGCTTTCTCAACTGATGGTTTTGT
ATTCGGTGAACTTGCAGGGTGTAGCAAATCGTGGTT
GCTCAATCCGTGTGGGCGTGACACTGAGAGGGAA
GGCAAAGGTATTGCTATCTTCACACTACAGTCTTTAT
CATTGGTGGATAATTGGATATTGGTAACTCGTCAAA
CTGGGTAAATATATGTTATGGTTCAACGTGTTGGGA
TGACCAAATAAACATTTTATATAATTATCAAAATCTT
CATAAACATATTGTTAATATACCAAACATGTTTCCAG
AAATTATAAAATTTCAACAGTAATCTGCCTTCTTGAA
TTAATCGATTTAGGAGGTGTAATGCATTAGAATCAC
AAATCGCCAACTGATTTTATTTTTATTTTTTCTTTCTG
AAATAACCTAAATTGACCGTTCATTAGTGAGTCTAA
ATTTCCACCTTTAAAAAAATTCTCTTTCGAAATCTGTT
TTTTCACGGGTCATGTTTACTATGTGCAGGTTATTTG
GAAGACAGACGCCCGGCATCAAACATGGACCCGTA
CACCGTGACCGGATTACTCGCCGAAACAACCATCCT
TTGGGAGCCTACCCTTGAGGCTGAAGCACTTGCTGC
CCAGAAGTTGGCATTGAATGTGTAAGACTCTCCCAC
GAGGTGATATACAACGAAGAAAGTGTCAACATGCA
TATTCATCCATGTTCTTCGTAAACTCGGTTTCCTGTTT
CTAGTTGATTTCTTGAAGATCTTGTAAATAAAGGTCA
TCACTGCTTCAAATTCAAGCTATTTTTAGCAAATGGG
TGTTTTTCAGATGATTATTGGACAGTTTATGCACAAT
TTGAAGTGTGCACAAGTGCACTTGACCCGGTCTGAG
CAGACATTATTTTCTCTTCTTGATTTAAAGAAAGCAC
CCTCACATTTTGGGGTATTTTCTCTTCATTTGATCAT
ATCATATAATTATCAATCGGTTTAGATGGGCTGCTGC
TCCTTTTTTGGTCAATTTTATTACTAGATTGCTTGTCA
ATGCTAATTATTTCGTTAAAATTGGAAAATGATGTAA
TTCATACTTACAATTCTTACTGCGAAAAGGGAGGCT
AAATAACAGTAGAACACTAGAACTTCAACAACAACG
AGAGTTATAATACAAGAGAGTTAAATAAGCATTTAT
ATAACTTAACTAAGTAAAATATACAACTATCTCTTTT
GCCCTCCCTGCTTGAAAACAATGGACTTAATATTGTG
GAATCACAGTCAGGAATCTCAACGAGTTAAAAAAAA
TGACGATGATGTACGTTACCATTTTTTAGTTATACAT
CACAAACATGTGTTCTATCATACAATGATGTGAAAC
ATGTATGTGTTGGTCAATGGTCATAATAAAATCATAT
GCACGAACCGACCAACTAGGAAAGGATGGATTGTT
CAGACCTTGATGGATTAAGATCAAAACAAATGTCTC
TACGGTAATGTTATCATCTAGTAGCTAGTAATTGGTT
ATAGAAACAATCGTTACACAAATCATCTACTAAAATT
ACAATAGTAAAAACCATCTTTCAACCATTGTCAAACT
AACAATGTATTACACATTCAACCGGTTACTAGTCTAT
AGATAGTTTTATTATTGGTTACATGGTTTGTAGTTT
CCATAATGTAATCAAAGTTCGTTATTATTTTACCTGA
TTAGTGGTACCCATCATGTGACCACACGATCTTACAT
ATAAAAGTTAAAGCAAGTGGAGAAATCATATATCTT
GTGATCCATGTGTGAGAATAATGATTTATCGGATAT
GAGTCTTATGTGGTGTGCGAGCTAGATAAGAAAATA
GTATATATGTTTTATGAAATGATCCGCGGTTTACAG
GACCAAAGAGTTCTAGCTCGTTCACCTTTTTATTTAA
CTTTAGGCTGAAGACATTAAAAAAAAAAAAAGGTTA
TAATACTACTTTGACCTCCATTGAAACCAAAACTATT
TGTCTTTCCAAACAGTCTCCCAAATGTACACCCAACT
TCTTCAAACTCACCCAATCTTCACTTTCAAACCCTGTT
CAATCTCTTCCAGCCATCCCCTTATCTTCATCAACACC
AGTCACCAATTTCCCATAAACCAAAGACCCCCAAATT
CATCCTTTCATTACAATCACAAAACCCTGTTCAAAAC
TCTCATAAACTGTACTCAAAATGCCGATTCTAATACA
CCAAAATGGGAAACTTGTTGCCAAAGAATGTAATC
TCTGCTGAGAAAATATTGAGGTCAATTGCTGGGGCA
ACTTCTAGTCCTATTTGTCAGTTCATCTCTTCACCTAC
TACTTTCTTGCACTCTGTTGACCCCAGGATTAAATTG

TABLE 1-continued

Glutamine synthetase gene sequences isolated from various weed species

| SEQ ID NO | SPECIES | TYPE | LENGTH | SEQ |
|---|---|---|---|---|
| | | | | GTAAAGTTTGTTGCTTTTTTGAAAATTCTTGTTATTG GTTTTTGGGTTTTTTCTTTATTGATAATTTTAAGTCTT TAACCATATTGTGATGTGATTTACCTTCTTCTTTCATG TTGAGTGTTGGGCTGGTCAGGGGGAATGGGTCAGT TACCCATTTATTCTGATGGTGTGCTTTTATGATTTAA GTTGATAAATTCCATGACTTTTTAGGGGATTCTTGCA ATTCTTCCTGGGTATTGCTTTATTGGGTATTTTGTAA ATTGGTTTATATGCTTTAGTATGTGTTAGTTCAATTT GTTCATTGTTGTTGAAAATATGTTGTGAAACATAGCC ATGGCTTTGATGGTCGTGCTTTTTTGTATAAAAAGTT GTTTTTATCTTTATGTAAGAAAAGATAGAGTGTCACT AGTAGTCTCTGTGATGGTAGCTTAGTTGCCGGGAAA GTTAAGTTTAATGCACTTTAGGTGGTCGGAGTTCA CGCTCTTGCATTTTTTTTATTTTTATTTTTTGCATTGT CTTGCAGTAGAATTTGCTTATCCTTAGGGACCTGATT GGGTTGAAATACTACTTAAGAAAAGTAAGTTTATAG TGATCAGAGCATTATCCAAGTCAGTTCGATTATTACA GAATTTATAGCTAGGGGATGTCT |
| 13 | Conyza canadensis | gDNAContig | 8635 | AAAGATGGGGCTTGAAAAGGTTCAAAATTTTAGACC TTTCCAAAATTAGATAATTTATTATTTTTTCTTTTTA AGAATTAAGCATTTAATTTATTTAGAAAGCTATAA GTGTTGAATCATCATGAAAATTGGCTTATAAAAATA TGTTAATATTAATATTATGAACCTTCAGAAAGATTTT ATGCCATAAATATTTTTTATGTATGATGACTGATGAT ATTGTGTAAATATCATAGATTGAAGACCCTTTCAAAC TTTAAAAACGGTGTTGATATCATCACTATTTAGAAAA AGAACTCTTTTTTTTTTAATGTGATTTATCTCAAACTT TTTATTTAAATCGTTAACTACCTGATCAACAGGCGGA TTTAAGTACAACTAATATCACACAAATGTCCAATTAA AAAATCATCTCATAATCTATATGGTCCATAACAAAAG TTGATAACAACAAAGTTATTAAGCACCTGAATATACT TTTGTAAAAGGTTAGCTAGAAAAAGACAATATATAT CATACCATCAGACTTCTACTTGTGGAAATAACGTTAC CAAGCACATATTTCCATATGAATTACAACATGCTAAC CTATATTAAATTACGTCTATGATCATTAACCCAACTC GATTTGGTATTGTGATGTGGTGATTATAACTTACAA CAAAGTACAATATGATAAAACTTGCTTTTTTTATATT ATTATTATATCCAAAGTCTCTATATTAATCATATTTAA AAAAGCTATTGACAAATCATAACAAACAACACATTT AAGTTCCATATATACTATCCATGAATCAATCAATGAA TCCAAAATTTTATTTTCATGATGATAAAAGGAAAAT AAGAAGAAAAAAAAAATAGTTTGAGGTTGTGAGAA AAAGCCTTATCTAGTTTCTCATCATATATGTTGAGTT GAGGCAAGGAATGAAAGGGAGAGGGGGCTTTTG TTTTGTTATGATGACCTTAAAAAGAGACCAAAAACC AATTTCCTCCACCCACACCCCTATCTCTTTAGGAAAG GCCAATCTCCCCTCCTTTGTTTTCTCCTTTTATTTTTA TATATACTTTTTATTAAAATAAAACATATACTATTTAT TTATTTTTACATCCATTTATCAAACAAACTTGCAACTT TCTTCTTTTCATTCATTTTGCCGCTCTCAACCATCACT TTTCTCTACTTTCCGGCCGGTACGTTCCTCCCTCCCTC CCTACATTACGTCATTGTTTTACTCATCACTATTTACA CACAAACATATGACTTAATGTATACATATAATTTTGT ACGGAACTTTTGCGATTTATCAGCCGCACACTCGAA CTAAATTTTTTGATCGGAAATGTAGCCATTATATATA TATATACACACAGAGAGATATTAAATATATATAT ATATACACAGAGAGATATCAAATATATGCATAGCAT ATATATGCGTGTGTGTGTATGTATATATAACTTTG CTAGTGTTAATTACTCGAAATGACGATGTATAACAA GTAGTAGTAAATCAGTAGAAACGGCGTCGTCCTATT AGTGTATGATGGCAACTACAAGTAGTAAATCAAGCC TAAAAGTTTGTTCAATATTAAAAATTAAAATAAAAAC CAGGCCTGAAAATGTGGAAGGGTTGTTAGTGGTTA AATTAGTTGACCTGGATGGAGGTAGGTCAGATGAT AATAGTAGCTGTTGATCCAGGCCAAGTGGAGGATC ACCACACACTTGTATCTACTCTTGATTATTTTATTATT TTTAAACTGCTACTTTTGATTAATCATTAATTTCATAT GAACATTTTAATATAAACATTTTTGCATCTGAAAATG TTTTTCCATCTGCTAAGGATGAAAGGACCAAAATGC CCTTCCATGCTGTTCAATGTTTTTCATAATTTAAAAG GTTATATATATATTTATTAATCTAGCTAGTGATTATAT ATGTTGCCTTTTGAATCTGATGATCTTTTTTTGGCCA GCTACTTGAATATTGTTAAATAAATTTAGAAAAATAA |

TABLE 1-continued

Glutamine synthetase gene sequences isolated from various weed species

| SEQ ID NO | SPECIES | TYPE | LENGTH | SEQ |
|---|---|---|---|---|
| | | | | ATATATGAATGATAAGTTTTAACTTTTAGGTAAAAG
GATCTTGATAAGCAATAGCTGAAAGTCCGGAGCTAG
AAAGGGCTTGGTATTGGTGGGACGTAATTGAAAAG
ATATACAAAATTAAACATTTATGATTTTTGCATCTGT
TTGTATTTAGTGTGTCGAATGAAAAGTAAATGTATA
AAGAGTTGTGATAAATTTTTGGATCCGAACTGGTAC
AGTGGTACATTACAGACACGGGCGAAAGCTTGGAG
TGTTACTTTGATCCTAGATCTTAATAGACGAGATTCG
TTACATATTAACTAATAATAGAAATGCAGCAATGCC
CCCCTTGTTTATATTAAAGATTCATTTTTCTCATGTGT
GAATTATGATTTTTTGATAAGACAAAAGTTGTTTACT
TGAAGTTGAATGATGTGGGTTCCTACTTGTTTTAAA
AATGTGTAACCTCTTATCTAAAAACTCTGTACTTACG
ATGATCACAAGAACCTGCATTGCTGACCATTTATCTT
ATTTATTGATATTTTTGTGTCTGATAATATGGGTAGG
TGAAAATGGCACAATGTTTGGCTCCTTCAGTACAAT
GGCAGATGAGGTTAACAAAAAATGGTATGAATCA
AGCTCTATGTCATCCAAAATGTGGAACTCTTTGTCCT
TGAAGCAAAGCAAGAAAGGAGCACTTAAGAACGCC
ACAAAATTCAGCATCTGTGCTTCAGCAAATGGAACC
ATTAACAGGATGGAAGACCTACTAAACTTGGATGTC
ACTCCTTACACCAATAAGATCATTGCTGAATACATTT
GGTATATTTCATTCTTTGGATACACTTACCATACAAA
TTTCAGGCTTACTAACATATTAACAAAAGTTTGTTAC
GTTACTCTAAAGGCTTGTTCAATTCTTATTTAGTCCT
ATGCTTTCTACTTTCTGAAACAGGATTGGAGGTTCTG
GGACAGATGTGCGCAGCAAATCAAGGGTATGTTGG
GTTTTGATGCTTTGGTTTCTTTCAGTAATTATCTATAG
CTTCGCTAAAAGGAAAGATTGTAATATATGTTTCATT
ATATCTCTTGTAGACACTCTCAAAACCAGTTGAGCAT
CCTTCTGAGCTTCCAAAATGGAACTATGATGGATCA
AGTACTGGACAAGCTCCAGGAGAAGATAGTGAAGT
TATCTTATAGTAAGTTTTATTTCAAAAAATCACAAGT
CTCTTTACATGTGGTGATGTAACCAAAGTTGAAATTC
TGTATTTCAGCCCCCAGGCAATCTTTAAGGATCCTTT
CCGTGGTGGCAACAACATCTTGGTGAGTATAACGTT
GGTTCATTATACTATAAAGTCTTATGTATAAGCTGAG
AAACTCCCACCAACCAAAAGGTTGCAGTTTCGAGTT
CTATATGGACAAGTGCATGCGAATTTTTTCCCCTTGA
AAAATAAGGATACAAACTGAAATTGGACAACATATG
GCTTAAACTGATTCTGTACTGTTTTTATAGGTGATCT
GTGACGCATACACTCCGCAAGGCGAGCCTATCCCTA
CTAACAAACGTGCTAAGGCTGCTGAGATTTTCAGTA
ATCCTAAAGTTGTATCGCAAGTGCCCTGGTAGGCTT
TTTGGGTGAAAATGTTCTTTTTTTCCCCCATAGAAC
TAAACTCTTAAATCCCTGTGTTTGATAATTGATACAT
ACATTAAACTTCTTGTCACATGAATAAGGGGCAGAT
AGGTCTGACTTTATTAGTCAACATACACCTCCCTTTT
ATGTGAACGGGGATACTCTACTAAAACAACAAAATA
AACAAATATTGCCTCTGTTTATTTCCCGGTAAAATTG
ATTTTAAATTTGGTTTTAGGTTTGGAATTGAGCAAGA
GTACACTTTGCTTCAGACAGATGTGAAGTGGCCTTT
GGGTTGGCCTGTTGGAGGCTACCCTGGTCCTCAGGT
ACTATTCATGATCTAACTTTTGTAAACTTCTACACCTT
CCTCATTTATAAATGGGATTTAATATCAGTTAAAGCT
AAAGGTGGCAAAATGAGTGGGCTAGATTGACCTGA
AAGACTTTTTTTTAAACTAATTTTTTAGTTTTCCCTAT
TTATAATTAGTGTGCCAAATATTGTTATAATCATTTA
ATTTCAAAAATAGTTTATCTTTTTTTGAGTAACCATTA
TACTAAATTCACTCGTTTGAACCATTAGAGATAAAGC
ATAACTGAAGAGCGATTCTTTCATAAGCAATGAATG
AAATTTTCCACCCTTAAAAACAAGTGTTCTTATTAAA
TGTATTTCCTTTTGAAACTACAGGGTCCATACTACTG
TGGTGCTGGAGCTGATAAGTCGTTTGGAAGAGATAT
ATCGGATGCACATTACAAGGCCTGCCTGTATGCCGG
AATTAACATCAGTGGGACCAATGGAGAAGTTATGCC
TGGACAGGTTTTTTTCTACTTCTTCACCTTATTATCT
AATGAATTATGAAAAGAAGTATCATGGCAACAATTG
TGTTTCACAGTGGGAATTTCAAGTTGGTCCTAGTGT
GGGAATTGAAGCTGGAGACCATATCTGGTGTGCTA
GATACCTCCTTGAGGTAAATCATCTTCAGCAATTTGA
TACAGTAACAACTTAATATATCCTACCGTGTTTTTTTA
ATCTATATCTAATTGTTTCTTGTGACTTTACTGTATTT
AACAGAGAATTACTGAACAAGCTGGTGTCGTGTTGA |

TABLE 1-continued

Glutamine synthetase gene sequences isolated from various weed species

| SEQ ID NO | SPECIES | TYPE | LENGTH | SEQ |
|---|---|---|---|---|

```
CCCTTGACCCTAAGCCTATTGATGTAAGATATATCTT
GTTTGATGACTACTTTCCTTCAATTTTCCATCATAGTG
TTCAAATCTTGCTTAGGGAGAACATTTGAGCAACAT
GTAATGTCACTCTTTTGTAATTAGAGGTGGTTAGAT
AGGCATGTTGGTTAATGTGTCCAAATGTACAATTCTT
TGATGACACAAGCTTAGTTGACCATAAACACTTTTTT
CCTTTTGTTTTTCTTACAAAAAAGACGAACAAGATAA
TTGGCAATTCAAGCTATATTAAAATTCAAAAATTTAA
ACTTTTTGAGTAAAAAGGAATTTCAGGAGGTGTTAT
GAGCTAATAAAAGTATACATTTTAGGTCACTCATTTG
TGTCGATTTCATTTTAAGCTACTTCTATTGGGTTTAA
CAATGGGAGGCACAGAAAACGCCTCAGTTGACCCTT
TGATAACTAAACGGGTTGAATTTGCCACCTCTACCC
GCTCTGAATGATTCTGATTTTATTCTTAACTTACACA
ACGCTTGTTGATTTGAATTGGCAGGGAGACTGGAAT
GGAGCAGGATGCCACACTAACTACAGGTACTTGTTT
TCTTTACTCATAATAGACCTGCGTATTGTTTTTGAAA
CGCTCTAATGTGTGTGAACGTTGATTTCTTTCTTATA
TTAAAAATCCATTCACTTACTTTTGTGCTTTCAAATTT
CAGTACATTGGCCATGAGAGAAGAAGGTGGGTTTG
AAGTAATTAAAAAGGCGATTCTGAACTTGTCACTTC
GCCACACTGAGCACATCAGTGCTTATGGAGAAGGC
AATGAGAGAAGATTGACAGGGAAGCACGAAACTGC
CAGCATTAACCAGTTTTCATGGGTATAAAACATTTTA
TATCGAATTATAAGAGATAAACCAAAAAAAATAATT
TACACTTTCATAAGCTTTCTCAACTGATGGTTTTGT
ATTCGGTGAACTTGCAGGGTGTAGCAAATCGTGGTT
GCTCAATCCGTGTGGGCGTGACACTGAGAGGGAA
GGCAAAGGTATTGCTATCTTCACACTACAGTCTTTAT
CATTGGTGGATAATTGGATATTGGTAACTCGTCAAA
CTGGGTAAATATATGTTATGGTTCAACGTGTTGGGA
TGACCAAATAAACATTTTATATAATTATCAAAATCTT
CATAAACATATTGTTAATATACCAAACATGTTTCCAG
AAATTATAAAATTTCAACAGTAATCTGCCTTCTTGAA
TTAATCGATTTAGGAGGTGTAATGCATTAGAATCAC
AAATCGCCAACTGATTTTATTTTTATTTTTTCTTTCTG
AAATAACCTAAATTGACCGTTCATTAGTGAGTCTAA
ATTTCCACCTTTAAAAAAATTCTCTTTCGAAATCTGTT
TTTTCACGGGTCATGTTTACTATGTGCAGGTTATTTG
GAAGACAGACGCCCGGCATCAAACATGGACCCGTA
CACCGTGACCGGATTACTCGCCGAAACAACCATCCT
TTGGGAGCCTACCCTTGAGGCTGAAGCACTTGCTGC
CCAGAAGTTGGCATTGAATGTGTAAGACTCTCCCAC
GAGGTGATATACAACGAAGAAAGTGTCAACATGCA
TATTCATCCATGTTCTTCGTAAACTCGGTTTCCTGTTT
CTAGTTGATTTCTTGAAGATCTTGTAAATAAAGGTCA
TCACTGCTTCAAATTCAAGCTATTTTTAGCAAATGGG
TGTTTTTCAGATGATTATTGGACAGTTTATGCACAAT
TTGAAGTGTGCACAAGTGCACTTGACCCGGTCTGAG
CAGACATTATTTTCTCTTCTTGATTTAAAGAAAGCAC
CCTCACATTTTGGGGGTATTTTCTCTTCATTTGATCAT
ATCATATAATTATCAATCGGTTTAGATGGGCTGCTGC
TCCTTTTTTGGTCAATTTTATTACTAGATTGCTTGTCA
ATGCTAATTATTTCGTTAAAATTGGAAAATGATGTAA
TTCATACTTACAATTCTTACTGCGAAAAGGGAGGCT
AAATAACAGTAGAACACTAGAACTTCAACAACAACG
AGAGTTATAATACAAGAGAGTTAAATAAGCATTTAT
ATAACTTAACTAAGTAAAATATACAACTATCTCTTTT
GCCCTCCCTGCTTGAAAACAATGGACTTAATATTGTG
GAATCACAGTCAGGAATCTCAACGAGTTAAAAAAAA
TGACGATGATGTACGTTACCATTTTTTAGTTATACAT
CACAAACATGTGTTCTATCATACAATGATGTGAAAC
ATGTATGTGTTGGTCAATGGTCATAATAAAATCATAT
GCACGAACCGACCAACTAGGAAAGGATGGATTGTT
CAGACCTTGATGGATTAAGATCAAAACAAATGTCTC
TACGGTAATGTTATCATCTAGTAGCTAGTAATTGGTT
ATAGAAACAATCGTTACACAAATCATCTACTAAAATT
ACAATAGTAAAAACCATCTTTCAACCATTGTCAAACT
AACAATGTATTACACATTCAACCGGTTACTAGTCTAT
AGATAGTTTTTATTATTGGTTACATGGTTTGTAGTTT
CCATAATGTAATCAAAGTTCGTTATTATTTTACCTGA
TTAGTGGTACCCATCATGTGACCACACGATCTTACAT
ATAAAAGTTAAAGCAAGTGGAGAAACCATATATCTT
GTGATCCATGTGTGAGAATAATGATTTATCGAATAT
```

TABLE 1-continued

Glutamine synthetase gene sequences isolated from various weed species

| SEQ ID NO | SPECIES | TYPE | LENGTH | SEQ |
|---|---|---|---|---|
| | | | | TAGTCTTATGTGGTGTGCGAGCTAGATAAGAAAATA<br>GTATATATGTTTTATGAAATGATCCGCGGTTTACAG<br>GACCAAAGAGTTCTAGCTCGTTCACCTTTTTATTTAA<br>CTTTAGGCTGAAGACATTAAAAAAAAAAAAAGGTTA<br>TAATACTACTTTGACCTCCATTGAAACCAAACTATT<br>TGTCTTTCCAAACAGTCTCCCAAATGTACACCCAACT<br>TCTTCAAACTCACCCAATCTTCACTTTCAAACCCTGTT<br>CAATCTCTTCCAGCCATCCCCTTATCTTCATCAACACC<br>AGTCACCAATTTCCCATAAACCAAAGACCCCCAAATT<br>CATCCTTTCATTACAATCACAAAACCCTGTTCAAAAC<br>TCTCATAAACTGTACTCAAAATGCCGATTCTAATACA<br>CCAAAATGGGAAAACTTGTTGCCAAAGAATGTAATC<br>TCTGCTGAGAAAATATTGAGGTCAATTGCTGGGGCA<br>ACTTCTAGTCCTATTTGTCAGTTCATCTCTTCACCTAC<br>TACTTTCTTGCACTCTGTTGACCCCAGGATTAAATTG<br>GTAAAGTTTGTTGCTTTTTTGAAAATTCTTGTTATTG<br>GTTTTTGGGTTTTTTCTTTATTGATAATTTTAAGTCTT<br>TAACCATATTGTGATGTGATTTACCTTCTTCTTTCATG<br>TTGAGTGTTGGGCTGGTCAGGGGGAATGGGTCAGT<br>TACCCATTTATTCTGATGGTGTGCTTTTATGATTTAA<br>GTTGATAAATTCCATGACTTTTTAGGGGATTCTTGCA<br>ATTCTTCCTGGGTATTGCTTTATTGGGTATTTTGTAA<br>ATTGGTTTATATGCTTTAGTATGTGTTAGTTCAATTT<br>GTTCATTGTTGTTGAAAATATGTTGTGAAACATAGCC<br>ATGGCTTTGATGGTCGTGCTTTTTTGTATAAAAAGTT<br>GTTTTTATCTTTATGTAAGAAAAGATAGAGTGTCACT<br>AGTAGTCTCTGTGATGGTAGCTTAGTTGCCGGGAAA<br>GTTAAGTTTAATGCACTTTAGGTGGTGCGGAGTTCA<br>CGCTCTTGCATTTTTTTTATTTTTATTTTTTGCATTGT<br>CTTGCAGTAGAATTTGCTTATCCTTAGGGACCTGATT<br>GGGTTGAAATACTACTTAAGAAAAGTAAGTTTATAG<br>TGATCAGAGCATTATCCAAGTCAGTTCGATTATTACA<br>GAATTTATACCTAGGGGATGTCT |
| 14 | Euphorbia heterophylla | cDNAContig | 1550 | CTCTCTCTATCCCAAATTTCTGCAATACCCACTTCCTT<br>TTTTCACCCAAAGCTAGGAGTGGGCGAAAATGGCG<br>CAAATCTTGGCACCATGTGCACAGTTACAGATGAGA<br>GTCCCAAAGAACTCGACACCTGCAAGCCCCTTATCA<br>ACAAAGATGTGGAGCTCTCTATTCTTAAAGCAGAAC<br>AAGAAATCAACGGCTAGGAACACTTCCAAGCTTAGA<br>GTTTATGCCGTCAAGTCCGAAAGTGGCACAATCAAT<br>AGGCTAGAGGACCTTCTAAATTTGGACATTACCCCTT<br>ACACCGACAAGATCATTGCCGAGTATATTTGGATTG<br>GAGGAACCGGTGTAGATGTCCGAAGCAAATCAAGG<br>ACTATCTCGAAGCCAGTTGAACATCCATCCGAGCTTC<br>CGAAGTGGAACTACGATGGATCGAGTACCGGACAA<br>GCGCCAGGCGAGGATAGTGAAGTTATTCTATATCCT<br>CAGGCTATCTTTAAGGACCCATTCCGAGGGGGTAAC<br>AATATCTTGGTCATTTGTGATGCATATACTCCAGCTG<br>GCGAGCCAATCCCAACCAATAAGCGCCATCGAGCTG<br>CCGAAATTTTCAGTAACCAGAAGGTTATTGATGAAG<br>TACCATGGTATGGGATCGAGCAAGAGTACACCTTGC<br>TTCAAACAAATGTGAATTGGCCTTTGGGTTGGCCAG<br>TTGGAGGCTATCCTGGTCCTCAGGGTCCTTACTATTG<br>TGCAGCTGGGCGGATAAGTCATTTGGCCGTGACAT<br>ATCGGACGCTCATTATAAGGCTTGTTTATATGCCGG<br>AATTAACATTAGTGGCACCAATGGGGAGGTTATGCC<br>TGGCCAGTGGGAGTATCAAGTCGGTCCAAGTGTGG<br>GAATTGAGGCTGGCGATCACATTTGGTGTTCAAGAT<br>ACATTCTTGAGAGAATCACCGAACAAGCTGGAGTTG<br>TTCTCACATTGGACCCCAAGCCGATCGAGGGTGATT<br>GGAATGGTGCTGGGTGTCACACTAATTACAGTACAA<br>AAAGTATGAGAGAAGAAGGTGGATTTGAAGTGATA<br>AAGAAAGCGATTTTGAACCTCTCACTTCGCCATAAG<br>GATCACATTAGTGCCTATGGTGAAGGAAATGAGAG<br>AAGGTTGACCGGAAAACACGAAACCGCCAGCATTG<br>ACTCGTTTTCTTGGGGAGTGGCAAATCGTGGATGCT<br>CGATTCGAGTAGGTCGTGATACTGAGAAGAATGGC<br>AAAGGTTACTTGGAAGACAGAAGACCCGCGTCGAA<br>CATGGACCCTTATGTGGTGACCTCGTTACTAGCCGA<br>GACTACGCTTTTATGGGAGCCAACTTTGGAGGCTGA<br>AGCTCTTGCAGCTCAAAAATTATCCTTGAAAGTATAA<br>TCGACTCGGTTCGAGAAATTCTCGAGCTTTCGGGAA<br>TTAGTAATTTCGTTAAAGTTCGCGTCTTTGGGAAAAA |

TABLE 1-continued

Glutamine synthetase gene sequences isolated from various weed species

| SEQ ID NO | SPECIES | TYPE | LENGTH | SEQ |
|---|---|---|---|---|
| | | | | TCATTTGTAAATAAAGGTTCCGATGCGAGTAATTTCT TTTTCTTGTAAAATGGTCTATAACTGATGTTTGACAT CAAAAGGACCACTTTTTTTTTTACTTTTTACTTTAT |
| 15 | Euphorbia heterophylla | gDNAContig | 3777 | AAAAATATTTGCACTATTAAAGTTTCAAATTTTTTTAT GACTTTTATTTCATATGTGATTATGCTTGTTCTGCTTC GTAAAATGTCGACTTTTTCGTTGTCACACAGTGGGA GTATCAAGTCGGTCCAAGTGTGGGAATTGAGGCTG GCGATCACATTTGGTGTTCAAGATACATTCTTGAGG TATTATTAATTTTATTTTACCGAGTCTCATCTATCAAG TCGGTCCAAGTTTGTGAATTAATTTCGAAGAAAGGC GGTCTATGTTTTAGTTTCGGATAAATACCGTTTCAAT AATCACCTTTTATGACAGAGAATCACCGAACAAGCT GGAGTTGTTCTCACACTGGACCCCAAGCCGATCGAG GTGATTCCGACTCACATCTTCATATTGCTTTTTCTTGT TTTAGAAAATAAAAAAAATCAACTTAAATCGAACTT GTTTTTCGATAGGGTGATTGGAATGGTGCTGGGTGT CACACTAATTACAGGTAACTTAATGTTAATCGATCTC GATTTTGAACTCTTTTTAGTTTTTCCATCGAAAATAA CAAGAAATTTCGATTTTTTTAAACCCGTATCTTTCAG TACAAAAAGTATGAGAGAAGAAGGTGGATTTGAAG TGATAAAGAAAGCGATTTTGAACCTCTCACTTCGCC ATAAGGATCACATTAGTGCCTATGGTGAAGGAAATG AGAGAAGGTTGACCGGAAAACACGAAACCGCCAGC ATTGACTCGTTTTCTTGGGTAAGCCTAAAAACGAAA CTTTATCCGAAACAAATAAAAAGACGACGACTTTTC GTAGCTAATTTGGTTCTAATCATGATTCATCGAAATT TGATTTTAGGGAGTGGCAAATCGTGGATGCTCGATT CGAGTAGGTCGTGATACTGAGAAGAACGGCAAAGG TATTCTATCTTAGGGGTGAGCAAATGTCAGTTTGAA AACCGAACCGAAAACGAATAGAGAAAAGGAGTGA ACCGAATACAGAACCAAATTAATTTCGGTTCAGTTC AAACTGAACCGAATTATTTCGGTTCGATTCGTTTTGG TTTTGAACCAAATAAATTTTTCGTTAACTTTATATTTT TAAATATACATTTAAATATATAAAATGACAAAAAAAT CAACATAGTTATCTTTGAACACAAATACATTATTGTT AATTTGAAAGAATAACTTTATTTTCAAGTATAAAAT GTAAATTGAACTAAAAACATAAATAAATTAAACATG AAAAAAATAAAAAAAATCCAATTCGGTTCGGTTTTC GGTTTTTTCAGGTTATGACCATAAAAACCGAACCGA ATAAGTTCGGTTCGGTTTCTTGGTTTGGTTCGGTTTC CGATTTTTTTGCTCTCCCCTAGTCTATCTCGAGGAAA TTTGATTGAATTTCTCAAATGGAAATTCTCGATATTT TGCTGACCTGGCGCGTAATTCTTCGGTTTTTTAGGTT ACTTGGAAGACAGAAGACCCGCGTCGAACATGGAC CCTTATGTGGTGACCTCGTTACTAGCCGAGACTACG CTTTTATGGGAGCCAACTTTGGAGGCTGAAGCTCTT GCAGCCCAAAAATTATCCTTGAAAGTATAATCGACT CGGTTCGAGAAATTCTCGAGCTTTCGGGAATTAGTA ATTTCGTTAAAGTTCGCGTCTTTGGGAAAAATCATTT GTAAATAAAGGTTCCGATGCGAGTAATTTCTTTTTCT TGTAAAATGGTCTATAACTGATGTTTGACATCAAAA GGACCACTTTTTTTTTTTTTTTACTTTTGACTAGTC GAGAACCCGAGTAATTTTTTGTTGTTTGAAGCATCG GCGCCTTTGACTATGATTTGATTATATAACATTTCTG TTCTTGATTTAATTGCATTTAAAATATAATAATTCGA GGCCTCTCGGAAGTTTGGAAATCAGGTTTTCGGTAT AAACCCAGGAAGCCGAAAAAGCTTGTGGCACACTA AAGGAGAGATAAAGTGAACAAAGATAAAATTACAG GTATTAGTATAACTTTATTCCATTTGTCTGCAAAAGA CGAAAACTTGTAAACTATGCAAGAATCAATTTCGAT TCTTTGCCCTCAAAAGACCGAAACATTTCTTTCGTTTT AAGATAGTATGTTCTAAAACAAAAAATATTCGTTAA AAAAACTCTGCTTTGCATTTATATAACTCTACTCTAA CCTCAGCAAAGGCCAAAAAGGCAAAAAAACATTGA AATTTCTCGGCTTTCCAAGGCGAAAAAACCGATCAA ATGGCATCCGGATCATCGAAATCGGTAGCCTTATTG CTTTCGATAGTCAACATTGCCCTCTACTTCATCATTAT AGTAATTGCTTCATGGGCTATAAACAAAGCAATTCA CCGAACTCACGAAACCGGTAAATATTTTAATTTTAAG TTAATTCTAAATTTAATTTAGTTTTACTATACTAATCA TAATTTTTAATTCAGTTTCGGTTTTGTCAATCCCGGC TCGAATTTCCCCATATTTTTTCCGATGGGAAATATG GCAACCGGGTTTTTCATCATATATTCCCTACTCGCCG |

TABLE 1-continued

Glutamine synthetase gene sequences isolated from various weed species

| SEQ ID NO | SPECIES | TYPE | LENGTH | SEQ |
|---|---|---|---|---|
| | | | | GAGTTGTGGGAATCGCTTCCTCACTCACCGGAATTC<br>AAAATTTATCGAAACCGAGTGTCTCGAGTCTACATG<br>CCGCTGCGGCGATTTCTATGACTGCCCTTTCACTTAC<br>TTTACTAGCCATGGGGTAGTTTTTGAAAAATTCGTTA<br>CTTATTTATGCTTATTTGTGTTTCCTATGAACATAAA<br>GTTTTGAACTTTTTTTTTCGGGATTTTGTTTCGTAGA<br>CTGGCGTGTAAGGAAATACAACAGGGTTGGACCGA<br>TTCGAACCTGAGGACTTTGGAGATTGTGACAATAGT<br>TGTGAGTGGTACGCAATTGGTGAGCACCGGTGCTAT<br>ATTTTCTGGGATTAATTGAAGATGTTGCGTTAGAAG<br>AAAACCGAGCCGTGTGGATTGGGAGGGTAGCTCGA<br>AAAGTTTTTCGAAACTCGGATTTGAATTTCGATTTAT<br>TCTAACTGGAGTTTTCAAGTACAAATGTATGTTTGCG<br>AGTTCAGTTTGAAGTCTTTAAGCATTTGTTTGAATTT<br>GCATGTTGGTTGTGTAATTTAGTTAATATTTTTACAA<br>TGTTAATAATGAACCTAGCTATTTCATATATTCTCTTG<br>ACATGGTTAAGAGTATAAATATGAATATATATTTATA<br>TATGAATATGAACCTAGTTATGTAGTTAAGAATTTAT<br>ATATATTTTATAAACAAACATTTCAAGTTGTTATTA<br>TATAAACCTAACAACAAAAAAAGTAATAGTTAAAT<br>TATAATGATAATATTATTAATATATACTACTTTATAA<br>AGCTAACTCGATTACATTTTTAATCAAAATTTCGTAT<br>TATATGAAATTAAATATTTAAGACATATTTTAACTAA<br>TCCGTAGCATTATTATTTCTCTTTCAAATCGAATTATT<br>AGTTGAATAAAAGGAAAATTTATAATTTATGATTAA<br>AATCAAACTATTTAAATACAAAAGATCAGACGATTTT<br>TCTCGAATGTATACCTTAATTGCAATTTTATTAGAAT<br>TGAATTGGACCGACCAATTGCACTGATTTGATTTAC<br>GGTTGAACTCGATTTTACAAATAAAATTATAAACTAT<br>TATCTTAATGTCTAGTCCAATTTCAATAACATTTGAA<br>CTGAATTTTTCAAGCCGAATTTATGGTTAAATTTAAA<br>TCTTATAAATTCTAATTAATTACATGTATAAAAGGTA<br>AATTCCAATTTTAAACAAATAAAAAAAAAACCTTTTT<br>CCGAGGTAATC |
| 16 | Euphorbia heterophylla | gDNAContig | 1755 | TTTATGCCGTTAAGTCAGAAAGTGGCACAATCAATA<br>GGCTAGAGGACCTTCTAAATTTGGACATTACCCCTTA<br>CACCGACAAGATCATCGCCGAATATATTTGGTACAT<br>TTTTTTTCGCCCTTTTTAATCTTTTACCGAAATGTTCG<br>TCATATTTTGTATTATCACATATTGATAATCACATTTT<br>GAATTAGGATTGGAGGAACCGGTGTAGATGTTCGA<br>AGCAAGTCAAGGGTAATTCGGCATTTTGAATATTTC<br>GGCGAATCGATAAGTTTATTTATTTGTACGGTTTTTG<br>ATTTATTGTTGACTTTTCGTGTTTTTCAGACAATCTCG<br>AAGCCAGTTGAACATCCATCCGAGCTTCCGAAGTGG<br>AACTACGATGGATCGAGTACCGGACAAGCACCTGG<br>CGAGGATAGTGAAGTTATTCTATAGTAAGATCACGC<br>AAAAAAAACTCTTTGCAATTTATTCTTATTTACGATA<br>AGCATAGTTTTGACTTTATGTTTTTTCCAGTCCTCAG<br>GCTATCTTTAAGGACCCATTCCGTGGGGGCAACAAT<br>ATCTTGGTAAGTTTTTCTATCAAATAGCTAGCAAATT<br>GGTCCTGAAATTTAGTCCATATTTTGTTTGCGTGGCT<br>AAATTTTTTGGGCTTTTTCTAAAATCCCAAGATTTTTA<br>GATTTTTTTTATAAAGTATATCCTAAACATAATTTATT<br>CTAAAAATACAAGATTTTAAATTTTAAATTTTGAGAA<br>TACCTTCTTTTTGGTCATAATAGATTTTATACCTTTTT<br>ATATCTTGATTTATGTATATTATACCTTCAATTAAAAT<br>ATACCGTATAAGTCAATTACCAAAGCTAAAAAAATA<br>AAATCATTATAAAATGCAAAATAAAATCGGTATAAT<br>ATCGAAGTTAGAAAAAACATCAAAACCATTACAAAG<br>AACAGAATCAAAGAATATAATACATATTTATACCAGA<br>TATTAGAAAAGGTGTAATACATATTATACGCAATTAT<br>AAAAAGGTATAATATCTATAATACCAAAAATCTTGT<br>ATTTTTAGAATAAAATATTATTTAAGATATTTTTTGC<br>AAAAAAAATCTAAAAATCTTGTGTTTGTTACAATTTC<br>CCAAATTTTTTTCGTTATTGTGTGAAGGTCATTTGTG<br>ACGCATATACCCCAGCTGGCGAGCCAATCCCAACCA<br>ATAAGCGCCATCGAGCTGCCGAAATTTTCAGTAACC<br>AGAAGGTTATTGATGAAGTACCATGGTAAAAACTCT<br>TCAGTTACTTTTTTTATTTCCGGGTTTTTACTGTTTGA<br>CCAAAAGATTCGATTTTTAATCATTTGAAAAGGTATG<br>GGATCGAGCAAGAGTACACCTTGCTTCAAACAAATG<br>TGAATTGGCCTTTGGGTTGGCCAGTTGGAGGCTATC<br>CTGGTCCTCAGGTAAAATTGTTTATGAGCTCTAAGTT |

TABLE 1-continued

Glutamine synthetase gene sequences isolated from various weed species

| SEQ ID NO | SPECIES | TYPE | LENGTH | SEQ |
|---|---|---|---|---|
| | | | | AAGTTCCTTATCGGTTTTTTTTCGAACTTGGGCAGT TAAATTACGTTTGGGTCCTTTTTTCAGGGTCCTTACT ATTGTGCAGCTGGGGCGGATAAGTCTTTTGGCCGTG ACATATCGGACGCTCATTATAAGGCTTGTTTATATGC CGGAATTAACATTAGTGGCACCAATGGGGAGGTTAT GCCTGGCCAGGTACACTTTTTTTCAGGGTTTTATTTT TTTAACAATTCAACATTCTAATAATTTAACCTTATTAT TGAAAAATTATGCGTCTTGATTTGAGTAATTTTCGGA GATTTTTTTATTTTTTAAAGTTTGTTA |
| 17 | Commelina diffusa | cDNAContig | 1587 | TTTTTAAGCTCCTTCAAATCATCCATTCCCACATTGCC ATTTCCATTTCCTCAATCTCTTGAAATGATGGCTCAA ATGATGGCAAGTCCTATGCATTGCCAGATGCGGCTT CCGGGCAAATCCATGAGTTCCAAGCCTTTACTGGAT TCGAAAATGTGGAGCTCTCTGCTGCTCAACTCCCAG AAGAGCAAGACCAAGAGGAGGACCATCAACTTCAG GGTGAGCGCAAAGTTCGAGAATGGCGTTGTGCCGA GGATGGAAGATCTTCTCAATTTGGACACTAGCCCCT ACACTGACAAAATCATAGCAGAATATATTTGGATTG GAGGGACAGGCATCGACCTTCGAAGCAAATCAAGG ACGATATCGAAGCCTGTGGAGCACCCGTCAGAGCT GCCCAAGTGGAACTACGACGGGTCGAGCACTGGGC AGGCCCCAGGAGAAGACAGTGAAGTCATCTTATATC CTCAGGCTATATTTAAAGACCCATTTCGCGGAGGAA ACCACATTTTGGTGATCTGCGACACGTATACGCCGG CCGGGGAGCCAATACCGACAAACAAGAGGCACAGG GCTGCCCAGATATTCAGCGACAAGAAGGTCGTCGAC GAAGTACCATGGTTCGGTATTGAGCAGGAGTACACC TTGCTCCAGACAAATGTGAACTGGCCTCTTGGATGG CCCGTCGGAGGGTACCCCGGGCCCCAGGCCCCTA CTACTGTGCTGTTGGCGCGGACAAGTCCTTCGGGAG GGACATCTCGGATGCTCACTACAAGGCCTGCCTTTA CGCCGGCATCAACATAAGTGGCACTAACGGAGAAG TTATGCCTGGTCAGTGGGAGTTCCAAGTCGGGCCGA GTGTTGGAATTGAAGCAGGAGATCACATATGGTGT GCAAGATACCTTCTTGAGAGAATCACCGAGCAAGCG GGCGTTGTTCTCTCAGTTGACCCAAAGCCGATTGAG GGTGACTGGAATGGCGCGGGTTGTCACACTAACTAC AGCACAAAGAGCATGAGGGAAGAGGGCGGCTTCG AGGTAATAAAGAAGGCAATTCTGAACTTTCTCTTC GGCACAAGGAGCACATAAGCGCATACGGAGAGGG GAATGAGCGAAGGTTGACAGGCAAACACGAGACAG CCAGCATTAACACTTTCTCTTGGGGAGTTGCAAACC GTGGTTGCTCCATTCGTGTGGGACGGGACACAGAG AAAGAAGGCAAAGGATATTTGGAAGATCGCCGCCC GGCGTCAAACATGGACCCATATGTTGTTACTGCCTT GCTAGCAGAAACCACTCTTCTTTGGGAGCCAACACT AGAAGCTGAGGCTTTAGCTGCCCAGAAGTTGGCACT GCAGGTGTGAGATGGTGGCCATGAAGTTGAGGTCT AGCCATGAAATGTTAATGTCCAAAGAATTCAATCGT TCACTGAATTCAGCCTCTCCTGAATGTTTGTTGTCAT CTTACATTAATTCCTCTTGATTTTTATGTTGTTGGAGC TGTTTTTTTCTTGTGGTAATGTTCAGTTTCTCCATCAC AAGGAGTATGGCACTAGAGAGAATATAATTATCAAT AATTATATTTAT |
| 18 | Commelina diffusa | gDNAContig | 6900 | TTGTTTCAGTATTAAATTTAGAACAAATATTTTTAGC TTAGGGTTAGTTCTTGAACTTATTTAGAATGCTCGCA AAAGTGTAGTATAATGTGAAGGTATACTTTGTTCTA GAACAATATTTCTTAAGCTTAGCATTAGTCCATGTAT TTAATTTCAGAATATTAGCAATAGTATGTAGTATAAT GTGAAGGTGTACTTTGTTTTAGAACAATAATTTTTAG CTTGGCAATAATTTCATAATACTAGCAAAAATATAGT ATAATTTTTAGCTTGGCACTAATTTCAAAGTATAGC AAAAGTATAGTATAATTTTTAGCTTAGCATAAGACC ACTTTAATTTTAAGTTATTCGCAGAAAATACGTAAAA TGTAAAGTAAGGCATACTTTGTTTCAGTATTAAATTT AGAACAATATTTTGTAGCTTAGTATTATTCCTTGAAC TTAATATCAGAATCTTTGCAAAATGTATGTATAATGT GTAGGCATACTTTGTTTCAACATTAAATTTAGAACAA TACTTCTTTAGCTTAGCATTATCCCTAAACTTGATTTT CAGAATACTCATAAAACTTATATAATGTGAATTAAG GTATACTTTGTTTCAGTGTTGCCTGAACTTAATTTTA GAACATTCGAAAAGTATAATATAATGTGAAGGCAT |

TABLE 1-continued

Glutamine synthetase gene sequences isolated from various weed species

| SEQ ID NO | SPECIES | TYPE | LENGTH | SEQ |
|---|---|---|---|---|

ACTTTATTTCAATGTTAAATTTAGAACACTATTTTCA
GCTCAGAGAACATTCACAAAAGTACAATATAATTTC
AACGGGCATACTTTGTTTCAGTATCAAATTTAGTTTC
AATTTGTGTTCTTATCAAGTTTTTGTGCTAAAAAATA
GGATTGGAGGGACAGGCATCGACCTTCGAAGCAAA
TCAAGGGTAAGTACACAGTTAAAACCTGCAAAAAGT
AATGTCCAAATGGTGGTTCTGCTGTATCTTTTGTAAG
TGTTTCGATTGTGTTTCAGACGATATCGAAGCCTGT
GGAGCACCCGTCAGAGCTGCCCAAGTGGAACTACG
ACGGGTCGAGCACTGGGCAGGCCCCAGGAGAAGAC
AGTGAAGTCATCTTATAGTAAGATATCTGCGCCATT
ACCATTTTATCTTATAGTAAGATATCTGCGCCGTTAC
CATTTTAATAAGTAACTGTAACTGCTCGCGCTTTGCA
GTCCTCAGGCTATATTTAAAGACCCATTTCGCGGAG
GAAACCACATTTTGGTATGCATTTCATTATAAACATT
ACACTAATCTATTCTTGAGTTATCTGTAACTCAAAGG
GTCTAAATATTGAGTCCAGACTACTGTCGTTCTTCAA
CTAATGAACAACTAATTCAGGTGATCTGCGACACGT
ATACGCCGGCCGGGGAGCCAATACCGACAAACAAG
AGGCACAGGGCTGCCCAGATATTCAGCGACAAGAA
GGTCGTCGACGAAGTACCATGGTAAGTCCTGGCCTC
AGCAGTTTTAGTTGAGTACATGGTTTAATATTGTCCC
TACTAAAATTTATTTTTTGATGACAAATCCGAAACCT
TCAGGTTCGGTATTGAGCAGGAGTACACCTTGCTCC
AGACAAATGTGAACTGGCCTCTTGGATGGCCCGTCG
GAGGGTACCCCGGGCCCCAGGTAACATTTTTTTCTG
TTACTTAGTAATTACAACACTAGTCATTTGGTAACGC
AGTTTGGCTGTCACCAAAGCCTGTGTCTGTGAGATT
TTATTACAATTCAGCACCTTTACAGCTTCAGACCGTT
GAGACAATCTCCTCAATTTGTAGCCAAAACTTGAGA
GAAAACCAAAGCTATAAATTGACAAATTTAGTCCAT
AAGACCTATCATACACCTATATATAGCCTAGCATCCC
AGCTGTAAAAAATGTCTCGCTCCAAGCAGCCTACAA
CACTACAACTTGGAACTTGCAAAACTTTAGAATCCCA
GTTAGATACATTATCGACAACAGGGTTGCAACCAGT
CAGCAATTCCAGCAGAATTCCAGTAGCTTTATCGCA
CCAGCTTCCAAGTTTTTTCCACCGTCTTTGCAACTTCT
ATGTGAAACAAAATGTCGACACAAAGACTAACAATC
AAATTCCGAAGCTGAACATTCACAGTTACTGTCACAT
TTTATGTCGTCGAAATGTTATTTCTCTTAGTACCTGA
AATGTTAGCTGAATTCAAGAAATGTAAAGATCAACG
TGGAGTCTAGGAAATGTTATTCCTATTAGTTCTTATC
AAAATATTGAATACTTTCAGGGCCCCTACTACTGTGC
TGTTGGCGCGGACAAGTCCTTCGGGAGGGACATCTC
GGATGCTCACTACAAGGCCTGCCTTTACGCCGGCAT
CAACATAAGTGGCACTAACGGAGAAGTTATGCCTG
GTCAGGTGCGGAATTCATTTCATTTCAGCTCATTTTG
ATTTGAACATACCCGAAAAAATAAATTCCTGAAATTT
TATTCAAATCTGAACATGACCAACATTAGGGCACGC
CATTGTACTTCTCACAAGCTTCTCGGATTTTATCTGT
AGTGCTTGGAAATGCTGCTAAAATCTTTGACTTTCTC
TTACTGTCTATAAAAATATGTTGATAGTTTGGGAATT
TCAGATAAGTACTATTTTAGCTGTGAAATTAAAATAC
AGTGTACTGACCAATCGATGGATTCTGTAGTGGGAG
TTCCAAGTCGGGCCGAGTGTTGGAATTGAAGCAGG
AGATCACATATGGTGTGCAAGATACCTTCTTGAGGT
AATTTGGGAACATTTTTCTTAGTTTTATAAAATTAAG
AGTCGAAAAAACCATACATTATAACTTATACGGTTG
AACTCAGACTCAAACTCGATTGACATTTTTTTTTAGT
CTTCAAAGATGTTCCCAAAATTCGGAAGAAAAAGTA
ATAATTAAGAGAACATACTTGCAACGTACCTAAAGG
CACAAAGTTTTTCCCTTTTTGCGATATCTGACTAATTC
TTTGCATTACATGTATTAACTATTTCAAAATTACTCA
GAGAATCACCGAGCAAGCGGGCGTTGTTCTCTCAGT
TGACCCAAAGCCGATTGAGGTACTTCTAAAGGCAGT
TGCAGAAAGCCTGAAAGAAAAAGCATTATCGTGA
ATAACTTCTTCTAAAGACTCAAAAAATTTATTTTATTT
TATTTTTGTTTAGGGTGACTGGAATGGCGCGGGTTG
TCACACTAACTACAGGTGACTGAAAAAACACACATT
TATTTATTTATTTATTTATTTTGACGATACTGAA
TGAAGAACTAAGTCAGAATATGTGACTAATTAACGT
GTAGCACAAAGAGCATGAGGGAAGAGGGCGGCTTC
GAGGTAATAAAGAAGGCAATTCTGAACCTTTCTCTT
CGGCACAAGGAGCACATAAGCGCATACGGAGAGG

TABLE 1-continued

Glutamine synthetase gene sequences isolated from various weed species

| SEQ ID NO | SPECIES | TYPE | LENGTH | SEQ |
|---|---|---|---|---|
| | | | | GGAATGAGCGAAGGTTGACAGGCAAACACGAGACA |
| | | | | GCCAGCATTAACACTTTCTCTTGGGTACAGACAAGC |
| | | | | ATTTCCCTGAAATTTACTCAACTGTTGTGAATTTTTT |
| | | | | TTGGGTTGAAATTTTGATATGTTTTGTGTTTAAAGGG |
| | | | | AGTTGCAAACCGTGGTTGCTCCATTCGTGTGGGACG |
| | | | | GGACACAGAGAAGAAGGCAAAGGTATGGAGCTTA |
| | | | | AATTACGAGATTAAGTATTGTTTTACATAGAAGCTTC |
| | | | | AGACGAGCTCAAAAAATGGCTTTAAGCTCATTCACA |
| | | | | TTGCTATATTAATTTTTTAAAAAGAAGGAAATCTTAG |
| | | | | ATTACGAGATTAGGTAGTGTCATATACAGAAGCTTC |
| | | | | AATGGAGCTCAATAATGGTTTTAAGCGCGCATTCAT |
| | | | | ACATGCTAGATTCAGTATTGAAATGGTTTATTTATTT |
| | | | | TGCTATAGAATTTTTAGAGGAGTTCAAAAATGATTA |
| | | | | TAAGTGTACATTCACAGATGCTAGGTTTTGTATTGAA |
| | | | | ATGATTATTTTTTTTTAATAGAAGCTTTAGAGGAAC |
| | | | | TAAGAAATAGTTTAAGCACGCATCCACGTGCTAGAT |
| | | | | TGAAATGATTATTTCTTTAACTACAAAAGCTTCAGAT |
| | | | | GAATTAGAGATGACAATCAAGTGTCGCATTCACTAT |
| | | | | ATTCACATATGCTAGATTTTTTGTATTGAAATGATTA |
| | | | | TTTCTTTCACTATAGAAGCTTCAGGAGCTAAAAAATG |
| | | | | GTTTTAAGCACAGACTCGCTATATTCTGTACTGAAAT |
| | | | | TATTTCTTTCATCGTAGAAGCTTCGGAGGAACTTAAA |
| | | | | AATGACTTTAAGTGTGCATTCACACATCTAGATTTAT |
| | | | | ATTGAAATGATTATTTCTTTCACTATAGAAGCTTCAG |
| | | | | ACGAGCTTAAAAATCTTAAGCACATATGCTAGATTTT |
| | | | | GTATCGAAATGATTATATCTTTCGCTATAGAAGATTT |
| | | | | AGATGAGCTCAAAAATGGCATTGAGCGGGCACTCA |
| | | | | CATATGCTAGATTCTATATTGAAATGATTTATTCTTTC |
| | | | | ACTATATATAGAAGTTTTAGATGAACTCAGATATGA |
| | | | | CTTTAAGCATGCATTCTTACATGATAAATTCTATATT |
| | | | | GAAATGATTATTTCTTTCACTATAAATAGAAGCTTTA |
| | | | | GTTGAACTCACATATGCTAGATTCTGTATTGAAATGA |
| | | | | TTATTTCTTTCACCATATATAGAATCTTTAGAGAAATT |
| | | | | CAACAATAACTTTTGAGTGTGCATTCACATATTCTTT |
| | | | | ATTCAAATGATTATTTCATTCGCTATAGAAACTTTAC |
| | | | | ATGAGCTCCAAAATGTTTTTTAAGTGCGCAATCACAT |
| | | | | ATGCTAGATTCTGTATTGAAATGATGATTTCTTTCAC |
| | | | | TATATATAGAAGCTTTAGATAAACTAAAAAATGATTT |
| | | | | TAACTACACAGTCACATTTGCTAGATTCTGTATTGAA |
| | | | | ATGATTTTTTCTTCCATTATATATAGAAGCTTTAGAT |
| | | | | GAACTAAAAAATGATTCAAAGTTAACATTACATATG |
| | | | | CTAGATTCTGTATTGAAATGATTATGTCTTTCACTAT |
| | | | | ATAGAGAAGCTTTAGATGAACTCCAAACTGGCTTTA |
| | | | | AACGCACATTCACAGATGCTAGATCCTATATTGGAA |
| | | | | TGATTATTTCTTCACTACATATAGAAGCTTGAGATGA |
| | | | | ACTAAAAAATGATTTAAAGTGCACATTCACATATGCT |
| | | | | AGATCCTATATTGAAATGATTATTTCTTCACTAAATA |
| | | | | TAGAAGCTTGAGATGAACTAAAAAAATGATTTAAAGT |
| | | | | GCACATTCACACATGCTAGATTTTGTATTGAAATGAT |
| | | | | TATTTCTTTCATTCCATATAAAAGCTTTCTCCAATGGC |
| | | | | TTTAAATTCTCATTCACATATGCTAGATCCTATATTGA |
| | | | | AATGATTATTTCTTCACTACATATAGAAGCTTGAGAT |
| | | | | GAACTAAATAATGATTCAAAGTGCACATTCACACGC |
| | | | | TAGATTTTGTATTGAAATGATTATTGCTTTCACTACA |
| | | | | TATAGAAGCTTTAGATGAACTAAAAATTAACTTAGT |
| | | | | GCACATTCACATATGTTAGATCTTATATCGAAATAAT |
| | | | | TAATTTTCAACTACAGAAGCTTCAGAAGAGCTCAAA |
| | | | | AAATGGCTTTAAGTGCTTATTCATACATTTTTACTAC |
| | | | | CTTCTATATTGAAATGATTATTTCTTTCACTATAGTAT |
| | | | | GACACTCATTTACACAATTACACCACAAATACAGGA |
| | | | | TATTTGGAAGATCGCCGCCCGGCGTCAAACATGGAC |
| | | | | CCATATGTTGTTACTGCCTTGCTAGCAGAAACCACTC |
| | | | | TTCTTTGGGAGCCAACACTAGAAGCTGAGGCTTTAG |
| | | | | CTGCCCAGAAGTTGGCACTGCAGGTGTGAGATGGT |
| | | | | GGCCATGAAGTTGAGGTCTAGCCATGAAATGTTAAT |
| | | | | GTCCAAAGAATTCAATCGTTCACTGAATTCAGCCTCT |
| | | | | CCTGAATGTTTGTTGTCATCTTACATTAATTCCTCTTG |
| | | | | ATTTTTATGTTGTTGGAGCTGTTTTTTTCTTGTGGTAA |
| | | | | TGTTCAGTTTCTCCATCACAAGGAGTATGGCACTAG |
| | | | | AGAGAATATAATTATCAATAATTATATTTATGAAATG |
| | | | | GACTGTATTTATTTTTATATATTAACGGGATGGATAA |
| | | | | CTTGAAACAAGTATTTGTGTTTATGCTCTGGGTGTTG |
| | | | | ATTGACTAGTATTAATACTAGCAATCATAACTCCTAA |
| | | | | CAGAGCTGCGAAACTTTGAACCCGGAACCTCCTGGA |

TABLE 1-continued

Glutamine synthetase gene sequences isolated from various weed species

| SEQ ID NO | SPECIES | TYPE | LENGTH | SEQ |
|---|---|---|---|---|
| | | | | GAGATAAGATGCGGTGGTTTGCGAAATGAAATGCA ATGGTTGTTGGGTTGAGGCATATGTATGGAAGTCAT GCATATGATGCTTTGTGTCAGGGTTGCAAGTATTGG TTTTTGGGATAGGTATAGGTTCTAAATAATCCAATGC ATAACAATATCAATAGCTATCCACATCAGATTTGTTA TTAGATACAATGAAACAAATAATATGGACAAAAAAT AAGTTTTAAATGGAATTTTTTTTTCTTATATGGTTTCG GCTCAAACTAACTAAAATTACACGAATACGACCAAT TTTGCCTTATCTATTATCAAATCGACTCATCGACCA ACTTAAAAAATTGAACCAATAATTTGTAGGGGCGAA TGGCCCGAGGGGCATATTTGACTCGCATCAGGGGA AGTTTTACAACCGAACATAAACAAACGCCATTGCAA CAAAGGATATTATGAGAAACCGTGGTATGTTGGTG GGCGCAACTTATGTGTCATGTGGCGGGGATGAAAC TGCTTCCCACCTGTTGATGTTCGGTATTCAAGCCTTA CCTAATGTGAGTCTGACTTAGCTTGGTTATTCGGTTC GGCCCAGATGTGGGTTCAAGGGGGAGTACCTCCGG TCCAATTTGGTCCTTCTCTTAAGGTCGGGAGTCACCT GCAAGACCCGTGGATGTTGCCCTCGGGGTAGAGCC TCTAACGCTCAAGTCAGTTATTTGGTCCCTAAAAGA GTGCACGAGAGAGAGAGAGATACCTGTGGAGAT ATGGAGTATTTATAGCTCCTGTCACGTCAACATCGCA TCAGTACGGCTCCACGTGGCGAGCTCGATCGTTCGGC |
| 19 | Digitaria sanguinalis | cDNAContig | 1535 | CCTTCACTTCAACCACCACTCTCCGGCCACTTTTCCG GCCCCTCTCCGTCACTCCTCCGGTGAAAATGGCACA ATGTTTGGCTCCTTCAGTGCAATGGCAGATGAGGGT AACAAAGAACGCGATGGAACCAAACTCTATGACATC CAAAATGTTTAACTCTTTTGCTTTGAAGCCAAGCAAG AAAGGAGCCATGAAAACCTCCACAAAATTTAGAATA TGCGCTTCAGCAAGTGGAACGATTAACAGGATGGA AGACCTGCTAAATTTGGATGTGACTCCTTACACTGAC AAGATCATTGCTGAATACATTTGGATTGGAGGTTCT GGGACAGACGTTCGCAGCAAATCGAGGACAATCTC TAAACCAGTTGAGCATGCTTCTGAGCTTCCAAAGTG GAACTATGATGGATCAAGTACTGGACAAGCACCCG GCGAAGACAGTGAAGTTATCTTATACCCCCAGGCAA TCTTTAAGGATCCTTTCCGTGGTGGAAACAACATTTT GGTGATCTGTGATGCATATACGCCACAAGGCGAGCC TATCCCAACAAACAAACGTGCTAAGGCTGCTGAGAT TTTCAGTGATCCTAAAGTTGTAGAACAGGTTCCCTG GTTTGGAATTGAGCAAGAGTACACTTTGCTTCAACC AAATGTGAAGTGGCCTTTGGGTTGGCCAGTTGGAG GCTACCCTGGTCCTCAGGGTCCATACTACTGTGGTG CTGGAGCGGATAAGTCCTTTGGAAGAGACATTTCAG ATGCACATTACAAGGCTTGCTTATATGCTGGAATTA ACATCAGTGGAACCAACGGAGAAGTTATGCCTGGA CAGTGGGAATTCCAAGTTGGTCCTAGTGTGGGAATT GAAGCAGGAGACCATATCTGGTGTGCTAGATACCTC CTTGAGAGAATTACTGAGCAAGCCGGTGTTGTCCTG ACACTTGACCCTAAGCCAATTGAGGGAGACTGGAAT GGAGCAGGATGCCACACTAACTACAGTACAAAAGC CATGAGAGAAGAAGGTGGATTTGAGGTAATCAAAA AGGCGATTCTAAACCTTTCACTTCGCCACACTGAACA CATCAGTGCTTACGGAGAAGGAAATGAAAGAAGAT TGACAGGGAAACATGAAACTGCCAGCATCAACCAAT TTTCATGGGGAGTAGCTAATCGTGGTTGCTCAATCC GTGTGGGCGTGACACTGAGAAAGCCGGCAAAGGT TACTTGGAAGACAGGCGCCCGGCATCAAACATGGA CCCATATACAGTGACAGGATTACTTGCAGAAACCAC CATCCTGTGGGAGCCCACACTTGAGGCTGAAGCCCT CGCAGCTCAGAAGTTGGCATTGAATGTCTAGGGCCG ATCCATGTTCTTTGAAAATTCGGATTTCTGTTTCTAG TTTGATTTCTTCGACGTCTTGTAAATAAAGGTCCCAA AAAGTCATCATATTTAAAGCTTTTTGTAGCAACTGGG TGGTTTTTTATGAGACGATTATTGGACAGCTTATGCA CATTTTGATGTGTGTATAAGTACA |
| 20 | Digitaria sanguinalis | gDNAContig | 7358 | GAAGGGGAAAATGCCTCATCATTTCCCTTGGAAAGA GAGGGTGTCTAACTTTAGCAAGTGCATATGCGGAAT CGGCAATTAATACTACAGTTGAGATTCATGGAATCA AAGATGGAAAGATACAGAAATATTCATTTCACCACA TGCGTGGCTGTAATGAATAACCAACCAGGTATTTCT GTACTGTCACTAATGTGCTGGCATTGCAGCAGGACA |

TABLE 1-continued

Glutamine synthetase gene sequences isolated from various weed species

| SEQ ID NO | SPECIES | TYPE | LENGTH | SEQ |
|---|---|---|---|---|

```
AACCTTTCCTCCTTTTTCGTACGGTGCATCACGTGCC
ATGGGTTCATAATCTCTAGATCATGCTCAGAGAGAC
TTTCTTTTTCTTGCGGAACAAAATATTTGCACGCACG
AAACAAAATTAGATGGACCAACTATTATTTTGTGCG
TAACATCTTATAGATATATAGGAACGGTCCAAATAA
TACAATACAATATCTTATATAGATATATGTGAAAATC
AAAACAATATCCTTATGGATATTGACATATTGTGGA
AAAATCCAAACAACTCCACATAATGTGACATGCATA
TTGTATGAAAAATCCAAACTACACCATGATACACCTC
AAGGATGTTGTGGGAATAATTCAAACAACACGATA
GAACATCTTCTAGATATTGTAGAAGCCATGCAAACA
ATACATGCAACATCTTATAGATATTATGCGAAAATAC
CAACAACACTATGGAATATCTCTTAGATATTGTAGTA
ACAATCCAAATAACACAATAAAATATTTTGTGGATAT
AACGAACAATACAAAAACATAATGAAACATCTCACA
AATAATATATGAACAATCAAATGACACCACCAAAC
ATCTCGTAGATACCATGGAACATCTCGTGGATGTTG
CGAAAACTGTCTTAAGAAATATTGTGATATATATTAT
GAGACAATTTTTAGAAAAAACATCATGAAATATGA
GGCAATCCAAGTAATACCAGAGAAAATATCATATTA
TAGTAGGAACAATCTAATCAAATATCATACAAATAA
TATAAATAACACCATAAAATATCTAATGAATTATATA
AAAACAGAACGCAGGCACGGAGCAATGAAAGCACA
GGGCAATTTCCAGCCCTTGTGCCGATGAGGTGGCTT
TAGGTACGAGCGTGATTGAATAAAAAAAACATTTTA
AAAATAATTTCGGCTCCTTTTTGGGCTATCCCCAGAC
ATGGGAAAAGTTTTCAAATTTCTTTTACCCCTCCCTCT
GTGCTCGGAACTCATAATCAAATCAACCACTTCCGG
AGATAAAGCTGCCTGTGCGCAATTCAATATTTTCCCA
CACCAACTACTGCACGTCCTGATCCACGTCTCACTGA
CAGGCTGCCCCCAATTGGTTGGTCCCGCTTGTCAGC
GACGAGGCTGAGCGATCTCCTGGTACGGGATGGTC
CTACTTGTCAGCGACGAGGTGAGCGATCTTCTGTAC
GGGGTGGTCCCTCCCCGCACCTACCGCGTCGAAGAA
ATAATCGAATAGAATATACGCGGAACTCGAAAGGT
AAGATTTTGCAGCGGTATTTGTACGTGTATGGCGTA
TAGTATACGTATTTTGTTGGGATCAAGGGCTGGAAG
CTTGACGCCAACTTGTTTCCATCCCTTGGGTCGTCGC
CATTATATAGCCGCCCTCCTCTCCACCGATCTCTAAT
CCAGCACCACATCCTCCTCTTCTTCCTCCGCCTCCCAA
GCCTGCCCGTGCCACCGCCAGCCGCCGGCCATGGCC
TGCCTCACCGACCTCGTCAACCTCAACCTCTCCGACA
CCACCGAGAAGATCATCGCCGAGTACATATGGTACG
TCACGTCTCCTACTCCTTGTTAAGCGTCCGTCAGAGA
GAATCGATCTTGCTGGCCGCCGGCTGCCTTTCATGG
CGTCTCGGCGGCCGGAAACGGGCTCTGGTCGACCG
TCGCGTGTAAACGAAAGATCTTTGGGGGCGTTTGG
GGAGGGTTTTTGGGGGAGACGGAGGTTTCTCGTAG
ATTGTTGCGGATTTGCCTCCCTTTTCGTCTTCACCGG
CTGAAGCGGCGGCGGTATTAGTTCCCCCCTTCTCCTC
TGCCAGACACCAGAGCCTGCCACCCTGTGCAACTTC
TCTGTTTTCTCTTGGTGGTGATCAATTAATTGGTTGT
CTGCTCAATCTTCATGTAAAAAAAAAATCAAACTGTT
TTTTCTTTTATTTTTTTGCCGGTTTATTCTCCCATGAAT
ATTTGACTTCAGTTGGGGATATGCTTCAAGAGAGAT
GCAGTCGAAACTCGAAGTACTTGATGTACGTCTCTT
GTTCCTCCTGTTGGGGGAGGATATCTGAAGCGGCA
GTCGCTGCTGGCCAACTGGTTGGTCCCTCACGACAC
CGCGACGGCCAGATGATCTGTTGGCACAGTAATCCT
ATGTTTATGTGTTAATTTATCCCCCTGATGCCCTCAA
ATAGATTGCTCTTCTCCGATGAACATGGCGTGGAGT
TGTTCGGTTTGTTGGTGATTTGACCCTATCTTAATGC
ATGGCTCCTTTTCTGTTACAGGATCGGTGGATCTGG
CATGGATCTCAGGAGCAAGGCCAGGGTAAGATGAT
AAAGATTCCCACGCTTGGACTGGAATACTGTTTGCT
GTGACTCATCACTTATCTCTGAAGTCATCCTCTGAGC
TGTTCTTTGGCTTATATATCGGATCTCAGCTGGCTGC
CATGCTGCTTTCCTTTTTATTTTTTCTTAAAACTAGAA
AGATCTTTTTAAACATTAAAATTCATATCGATCTGG
TTGGTGCTTCGCAGACCCTCCCCGGGCCGGTGACCG
ATCCCAGCAAGCTGCCTAAGTGGAACTACGATGGCT
CCAGTACCGGCCAGGCCCCCGGTGAGGACAGTGAG
GTCATCCTGTAGTAAGTATCATGGCATGCCATCCCTT
CGCTTTTGTTCTATTGCTAGCAAAAAAGGAATGATCC
```

TABLE 1-continued

Glutamine synthetase gene sequences isolated from various weed species

| SEQ ID NO | SPECIES | TYPE | LENGTH | SEQ |
|---|---|---|---|---|

TTATCTCTTGTGCATGTGCCATCCTGCAGCCCGCAGG
CTATCTTCAAGGACCCATTCAGGAAGGGCAACAACA
TCCTTGTGAGTTTCCACTTTTAACATCCAAGGGATCT
GAATCATATGTTACTATTGTCATACAGCTACAGTTAA
ATTGATACAACTCAATCAGTCCACCCCTGTGAAAAA
AGTTTGTCTTGTTACTAATTACAGTAGGTATAAATTA
TGTTTTTAGTTTTTAATCTGCCTGCTGTATAGGTCAA
ATTATGGTAATGCAGCACTAAAGATTCCTAATGCAG
GTTCTCAACTCTGAATCTCTGTCTAGTTAGCAGAATT
GCAAATTATATAACATGCTGACCTGGTGACATGAGC
TTAGATATTTTTTGAACTAAAAGTCTGATTGTCCAGT
GTACCTAACCATAGGTTTAGGAATCTGATCGGTTGT
TTTGTCAACCTCTAATAATAGGGACCATTTTTGGGCA
TTCAATGAATTCGTTTGACCCGCAGGTCATGTGCGA
TTGCTACACCCCAGCTGGTGAGCCAATTCCCACCAA
CAAGAGGCACAATGCTGCCAAGATCTTCAGCAGCCC
TGAGGTCGCTGCTGAGGAGCCCTGGTACGCAAATCT
TTACTGAATAACTATGATAAAAGGCGAAACAATCAA
TATATTTACAAAATTGACCATGATTGTTTTGCCAATG
GCAGGTATGGTATTGAGCAGGAGTACACCCTCCTCC
AGAAGGACATCAACTGGCCCCTTGGGTGGCCTGTTG
GTGGCTTCCCTGGCCCTCAGGTAGACGATCACTTCA
TTAGTTGGCTTGCTTAAGATTTTATTCATTGATTCGG
TCCTACATTGGTTGGAGTGTCCCTTGACAGATTTCAA
TTATCTTTTAGGGTCCTTACTACTGTAGTATTGGTGC
GGACAAGTCGTTTGGGCGTGACATAGTTGACTCCCA
CTACAAGGCTTGCCTGTATGCTGGCATCAACATCAG
TGGCATCAACGGGGAGGTCATGCCAGGACAGGTGA
AATTTTACTAGACTTGGCAACCTGTTTTGTACCCTGA
AGTTAACATCTTTCTGACCATGGTAAAAATGCTGTG
GTTGGTTTCAGTGGGAGTTCCAAGTTGGCCCGTCCG
TTGGCATTTCTGCCGGTGACCAGGTGTGGGTTGCTC
GCTACATTCTTGAGGTATGGATCCAACTTCTGGAATC
TATATGTGATCAAATATAACACGATCTTCTTGAACCA
AACAAGATTTGCAGCACTTGAGCTAATCTGTCCCTTT
TTCAACAGAGGATCACTGAGATCGCCGGTGTGGTTG
TGTCATTCGACCCCAAGCCCATCCCGGGAGACTGGA
ACGGTGCTGGTGCTCACACCAACTACAGCACCAAGT
CCATGAGGAACGATGGCGGGTACGAGGTGATCAAG
TCCGCGATCGAGAAGCTGAAGCTGCGCCACAAGGA
GCACATCGCCGCCTATGGCGAGGGCAACGAGCGCC
GGCTGACCGGCAGGCACGAGACCGCCGACATCAAC
ACCTTCAGCTGGGTACGTCGTCCCCATTGTGGACTT
GGATTCCCCAATCCGTGGAAAGGGAGATTCGTGTGC
CAACTCTGTTTGTTCTGTCTCTTGCAGGGAGTCGCCA
ACCGTGGCGCGTCTGTGCGCGTGGGCAGGGAGACG
GAGCAGAATGGCAAGGGCTACTTCGAGGACCGCCG
GCCGGCGTCCAACATGGACCCCTACGTGGTGACCTC
CATGATCGCCGAGACCACCATCGTCTGGAAGCCCTG
ATTCGTCCCTCTCCAGCTCCCCGTCTCGTGTCAACT
GCTTCTGCTTCGGGCGGTGGCGGCCATGGCTACTAC
CTCTGGCGATTGCGTTGAACTGGGCACAACAAATGT
CCGATGATTCCGTTCCATTCCGTCTGGTTATACTATT
GGCATTTAGTTAGATCCATGTCGAGGGTTGTGCGAA
AACAAAACAGAACAAAAACCATTGTTTGCTTTGATG
CTTTCCACTTCCCATGCCTTCCGTTTGGGTGGTCACT
TGTGTAATCCTCCAATAATGACCGTACCGCAGCGGT
GGTACCTTCAGTACTTGCATCACTAGTGCTAGCCCTC
TTTTTTTTTTTCTACATGTGCATTGTGAGTGACAGTG
AGTGGGTGGGTGTAAATTGTATCACAAAAGTGGCTT
GCTTTGCTGCACCTCCAATGGCAATGGCTTTCTTCCG
GCGATAAAGAATCAATCATCATGGCTGTGGCGAGT
GCGGGCAGTGCGTGGCCGCACTGTGGTCGCCGATT
AAAGTAATCCTGTTTTAGGTCAGATTCTTGAACGGG
TTACTTGTCTTTTCTCCGAAAATTCAGCACCACCGGC
CATTGATCACTCAGGAATCTTGATCGGTTGGTGGAG
GGAGGGTCACGGAAGAGCTGAATGCTTGTCATCTT
GCACGGACGGACAAGTGGGGGGCACGAGAATCCAT
CAGAGATCACACAACAACTTCCCAGTTAGTTCCATG
ACGTATGGGCCCGCTGCTCTGTGGACCCCGTATCCC
ATCTTTGCAGCGAGTATGGGCCCGCTGCTCTGTGGA
CCCCGTATCCCATCTTTGCAGCGAGACCGCGTCCCGT
GCAGTTAGCGCTGCAACAGCCAACGCGCGTCAGCTC
CAGCCCTAGCCGGCACCAGCCCAGCCAACCGAATCT

TABLE 1-continued

Glutamine synthetase gene sequences isolated from various weed species

| SEQ ID NO | SPECIES | TYPE | LENGTH | SEQ |
|---|---|---|---|---|
| | | | | TCCTCTCATCACACAGACACAGCAACTACTAGATGTT
GCTATCCAATGACTGTTCCACAACATGGCCCCTCTTC
TCTCAGTTCGACTGGTCCGATCGGATCATCTGGTGG
AGCAGTACTAGCAGCTTGCAGCGCCAGCAATCCAGC
ATGTTATCGTCTCGAGCTCTCAACAACCCAACTACTC
TCAAAAAGAGAGGATGGCCCGGCCGGCGTTCTTGA
CGACGCTGATTTACAAAGTTGACCCGCGGGCACAAG
CACTTTTACACAGCATCCTCACCAACTCCGGCGACAT
TGTACGGGCACATCTTAACCGCTCGGCTTGAAACGG
CGATGCCATATGTTTTCTTTTCTCGCTAATCCCTGCCA
GGTCAAAGCTTGACAGTATCTGGGCTACCCACGGCA
CACTGAAAGCCTGAAACATCCAGTATCTTCATCCTCG
CACGTCTCGCCGCCGGGCTTTCTTTATGAGAAAATCC
AGCGTCTCTACTCCCAACTACAATTTTGTTCGTTGCC
GAGTCAAAGCATACCGTGCAGGTTGGTTCCAGTAGA
ACAGTGGCCCAAAGGCACGGCTAAGGTCAGCCATC
CTTTTGCGGCTGGAAAGGGCTGATTGGCCGGCACTA
TCTGTCACCCACGGAAGGATGGACGGAGAAGGAAA
CACATCAGCAGGCCGAGGCGCCACTTCGTGCTACCA
AAAGCTACTCGTGGCTCTCTGTCTTGTAGCCATGGA
TTACAGGATTAGAGCTCTGATTTCAGCGTAAACAAC
TCTGTTTCCAAGGAAAGCATTGTTTAGTACAATGGC
AGCAAACTGCGGCCCTGATGGTGAGAGAAACTCCG
GCGGAAGCGACAGAAACATGGTGCAAGCTAATCAG
ATGCTTCAGATAGGTATAATTATCCATGACACTGCCA
GATGTTGCTCGATTTCAATTTCTTTTAGGAAGAATGT
TCAATACACCTATATTCTGCTGCTGCTGCTGATCTGG
GCAAGAAACCTGAGCGATAGATGTGCGCATATCATT
TGTCATGCGCTGAGTACTGACAGATGACCGTGCAAT
TTGGAATCCTGGCTAGCGGTCATATTTGCGCACGAA
ATGATATTGGGTAAGGATTTATCTTTTATGAATGGA
CACAAACACACAAGTACTAGCGGTGGAGGTGGATT
TGGATTATCAACACTATAGTTGACCTTTTTTCTTTCAA
ATTTATTGGATTGCATCTATATTTGGATTTTGGATAT
ATTGGATTGGATCTATATTTGGATTTTGGATATATGT
GGATTACGAAGTTCACACTTGATATGGACATGGAAG
CAAAGCTTGCTGGCCGAGTGTGGCAAGAAAGCTGA
GCGACGGATAGATGGGAGCACATCACTTGCCATGT
ACTGACAAATGACCGTGCAATTTGGAATCCTGGGTA
GAGGTCATTTTTGCGCACGGAATGATATTGGGAAAG
CATTTATTTTCTATGGACGGACACAAACACACAAGT
ATACACAGGCACGTCAAAAATCCATGTGTGACGATC
TTGTGCTCAAGATCAATCATTCAAGGTTGAGCCATC
AGCACGAATGGACCAAATGGCATTGGAATCTGAGG
CTGCTGTCAACAAACAATTATTGACAGTATGGACTG
CTTTTCCTAATCACAATTGATGAAGCAGCTACGCTCC
AGTTTGCGGTGATGCGGAGGGCCCATTCAGCCAGA
CAGCAGCTGAAAATAACAAGGCACACAAAACATTCT
CTCACGTTCCAGGCTTAGACATGGAGCACACGACTG
TG |
| 21 | Kochia scoparia | cDNAContig | 918 | ATGTCGCTTCTCTCAGATCTCATTAACCTTGATCTTTC
TGATTCTACTGATAAGATCATTGCTGAGTACATATG
GATTGGTGGATCTGGTATGGACATGAGAAGTAAAG
CTAGAACATTGGAGGGGCCTGTTTCTGATCCGAAAA
AGCTTCCAAAATGGAATTATGATGGATCCAGCACTG
GTCAAGCTCCTGGTGAAGACAGTGAAGTTATTCTCT
ACCCACAAGCTATCTTCAGAGATCCATTCAGGAGGG
GAAACAATATCCTTGTTATGTGTGATGCCTACACCCC
ACAAGGAGAGCCGATCCCAACTAACAATAGATGCA
ATGCCGAAAGATATTCAGCAACCCAGAAGTTGCCG
CTGAAGTACCTTGGTATGGTATCGAGCAAGAATATA
CTTTACTGCAGAAGGATGTAAACTGGCCCGTTGGCT
GGCCTTTAGGCGGCTTTCCTGGTCCACAGGGCCCAT
ACTACTGTGGTGTTGGTGCTGATAAAGCTTTCGGAA
GGGACATCGTTGATTCCCACTACAAAGCCTGCCTTTA
TGCTGGAATTAACATCAGTGGAATTAACGGTGAAGT
GATGCCAGGACAGTGGGAATTTCAAGTTGGTCCATC
TGTTGGAATTTCTGCTGGTGATGAATTGTGGGTAGC
TCGTTACATATTGGAGAGGATTACTGAGGTTGCTGG
AGTTGCTCTTTCATTTGATCCAAAACCCATTCCAGGT
GATTGGAATGGTGCTGGTGCTCACACAAACTACAGC
ACAAAATCTATGAGGGAAGATGGTGGTTACGAGGT
CATTAAGAAAGCTATCGAAAAGCTTGGGTTGAAACA |

TABLE 1-continued

Glutamine synthetase gene sequences isolated from various weed species

| SEQ ID NO | SPECIES | TYPE | LENGTH | SEQ |
|---|---|---|---|---|
| | | | | CGCGGAACACATCTCTGCTTATGGTGAGGGAAATGA ACGCCGCCTAACTGGTAAACATGAAACAGCCAGCAT TTCAACTTTCCTGTGG |
| 22 | Kochia scoparia | cDNAContig | 867 | ATGGCCCAGATTCTCGCTCCTAGCATGCAATGTCAG TTGAAATTCTCAAAAAGCTCATTAAGCTCGCTAGCAT CGAACACGTGGACCTCCATTTTGCTAAAAGGAAACC AAAAGAGATCGCTTCATTGCTCAACTAAGTTCAAGG TATCCGCTGCTCTCAAATCTGATGATGGTACTATCAA CAGGGTAGAGCAGCTACTCAATTTGGATGTCACTCC ATACACTGACAAGATTATTGCTGAATACATATGGAT TGGAGGATCTGGGATTGATGTTCGCAGTAAATCCAG GACAATCTCAAGACCTATTGAGGATCCATCTGAACT TCCCAAATGGAACTTTGATGGGTCAAGCACTGGACA AGCGCCGGGAGAAGACAGTGAAGTAATCTTATACC CTCAAGCAATTTTTAAGGATCCTTTTCGTGGTGGTAA CAATATCTTGGTGATCTGTGATGCATACACACCAGC AGGTGAACCCATCCCAACTAATAAACGACACAAAGC TGCACAGATCTTCAGCAACCAAAAGGTTGTTTCTGA GGTTCCATGGTTTGGAATAGAGCAGGAATACACACT TCTTCAACCAAATGTTAATTGGCCCTTGGGATGGCCT GTAGGAGCTTATCCCGGTCCTCAAGGTCCATATTATT GTGGTGTTGGTGCTGAAAAATCTTTTGGACGTGACA TTTCTGATGCTCACTATAAAGCTTGCCTGTATGCTGG AATTAACATCAGTGGCACCAATGGGGAAGTTATGCC TGGCCAGCTGTATATCCACTTGTACCTACAGTGGGA ATTCCAGGTTGGTCCTAGTGTTGGGATTGAAGCAGG AGATCATATCTGGTGTGCCAGATATATTCTTGAG |
| 23 | Kochia scoparia | cDNAContig | 360 | ACTAAAACAATGAGAGAAGATGGTGGTTTCGAAGT GATAAAAAAAGCGATTTTGAATCTTTCATTACGCCAT AAGGAGCATATTAGTGCATATGGAGAAGGCAATGA GAGAAGGTTGACTGGAAAGCATGAAACTGCCAGCA TCGATTCATTCTCTTGGGGTGTTGCCAACCGTGGTTG CTCAATCCGTGTGGGCCGTGATACTGAAAAGGAAG GCAAAGGATACTTGGAAGATCGACGACCTGCTTCAA ATATGGACCCATATGTGGTAACAGGTTTGCTAGCTG AGACCACAATACTCTGGGAACCCACACTCGAGGCTG AGGCATTAGCAGCTCAAAAACTTGCTCTCAACGTGT AA |
| 24 | Kochia scoparia | gDNAContig | 5248 | ATAAAGGGAATTTTTAATTTTTTTATATTTAAATGCT AAATTAGGTCTCAAAATCTTAGGATAAAAAATGGAT GGAAAGAAAGGGAGAGAATCCTAACTCCGTATACG TATGAACTTTAAACATTAAAAAAAAATTGATTAAAG TTTGTCTAAAATAATTTCCTTCTTTTAAAAATGTGTAA TGTTGTTTGGATGCAAGTAATAAAAAACAAAGAAAG TATATACGAAAGTATGTAGACTGGTGTATTGGTGGA GGGAGATTTAAATATTGTGTTAGTTTATAAAAAGAT TGCTTTATTACTTAGGAGACTCCAAAAGATTGCTTTA TTTACTTAGCTAGATTTGTTCTAAAATATTTCATCATT TAATAATCCAAACCCCTTTCTCTTTCCTCTCCTTAGAC GGCGTGGGCCCACTCGACGGACGGCGTTGGTCCAC TCGACGGACGGAGTTGGACCACTCGACGGACGGCG TCTCTGTGTCTATCTCTCTTGTGTTGCGCTGCTGTTAT TCTTGCGTTGCGTTGCTTTGCTTTGCTACTGCTGTGT GGTTGCTCGATCTTAATATCATTGTTAGGATTTCGGT TTTTTTAAGGTATTCTACTTCTCTCAGTCTCTCTCCTC ATCTTCCCCCAATTCTGTGTTGAATTCTTTTTAATGTT TGAATTATTTTGCTAGAGTTTTGTGTGAATTTTGTTG GAATTATTTATGAGTTGTGTTTCAATTTCTATTGTTTG TGAGGTTACACATTATTGTTTGGTTTTGGGTGATTTT GGGGGCAGAATTATTGATGATTCTGGGGCTGAATTT AAAGACCAACAAAGAACTATAATATAATAATCAAAC TGCAACAAACAAAGCATAACACACATTGGAAATCAA GTTTGGTAATGGGCATTTAACACACATTGAGAATTT GTACCTTGAATTGGACAAAAATCAGAAGATAATTGT CCAACATTATCACAACAGGAACAACTGGTATACAGT AATTAAATCAATTGATACGGTAAATCGAGGAGGTCC CCTCGATAATTGGAAATGGACAACGAAAACCTTATC TAAAAAGTTGGAACCCTTTTTTTAAAAAAAAAATGTTT GATCAAATTTAGTCCAGAGATTCTTTTAAAACACAAT TTTCACCACTCAATCACAAACACCCCTATCTACTATG GAAAAGCCATGCTCAGCCATTTTTCCTCCTCTTTTCTT |

TABLE 1-continued

Glutamine synthetase gene sequences isolated from various weed species

| SEQ ID NO | SPECIES | TYPE | LENGTH | SEQ |
|---|---|---|---|---|

TTCAACCCACTATTTGCCCTTTCCCATTCTCCAAAATT
ATATTATCAATATTATTCTTTCTATATACTACAAACAC
TATCTTACATTTGGTCACTCTCTTCTCTTTCTCTCTCCT
GGCAGTTGACTCTCTCCATTCCCAATTGATTAGCAAC
AAGGTAGTATCTACATTTTCCCACCCATGTTTCTTTCT
TGCATTCAATTCTTGTTACTCTTTCTTGTGCTACTTCA
CTATCTTGGCAATTGTGATCTCGTCATTAAATGCATT
GCTGTCTCATCATCGCATTTATTTCATCTCTCATATGA
GTTAATGAGTACTACTTGCTATTATTGACAATGTATA
AGGTGATCTACTTTGTTTCTAATAAGTCACTGCTATT
CTGTGCTAAACTAGATTTATACTTATTTACAACTGAT
GACTGCTGATTTAGTGATTTAGTGATTTAGTGATTTA
GATCGTACTTTCTTTGTTTTGCTCGATTTTCGGACGT
CGATTCGATATATACAGATTTGATGAACAGCATTGTT
GCCAATGATCAGTAGTAGTAATGTTGTTGAAAGCTT
TCAGTTATAGTGATATCTTCCATCTGCTAGTTTTTTTT
AGAGGAAATCAGTTTTTGCTAGGAGGAAAAAGGGA
ATTACTAAAAAAAATTATAAATGTTCTTTCAAAATTT
GAGTGAAGAAAATAATGGTTATTAAACACTAATTTT
GAGCTGAAAGAATATGATCAGATGCTTTTGTATTCT
AATGTCTTGAATCCTAATATGCACCTTTAAAACCTTT
TGTTTTTCAATGAAAAAGTAAGGAAAAAGATTATTT
GCATTAGTGGCACGAGTCTAATCTAATAACCGTGGT
TTCGTCTCTTCTCTTTCAAAAATTGGAAAAGTGTTGA
TGTCATTTTCTAACATTTCCTACTAAGTACTAACCAA
AACAAGGTTTTCTTTCCACTAATAGAATTTTCCTTTAC
CACATTTATACAGTATAAAAATCTCTAACTTTAGACT
TTAGAGCATACTATCACATCATGGTGTTGTCATAGTA
TATTCATATTAGAGCAGGTTTAGCCCCAAGTCTGAA
GACTTGGGATGAAATTACCTTTATTGTCTTAAGATTT
AGATTTAAGATTTTCCCATTTTTCTTTTAAAATCTTAG
CCAGATCTCAAGTTGATTTCAAGGCTCAACTTAAGA
CTTGAAACACGGGACCCACCCTAATTTAATAATGTTT
GTTTTCATATAGATAACATAAAGAGATAAAAAAAAA
GTAAAATATCATGGTATATATTTAAGACTAGGAGTC
TTAGGGCTAAAGTGATAAAGTTGGACAAGTTTTATG
GAGTTTAAGAAAACATTATTTTTTGTGGGAACCACT
AAAAAATGATGTTACACCCAAGTTTTAAGACTTGGT
GCTAAGCTTGCTGTTACAAATTGGTTTCAATCATAAC
AGTTATTCCTTATCTTTGACTTGGAATTTAGTCCAAA
TCTTTTGTTGTGGTGTACTGGTGTCGAGGATACAAC
ATGGATACCTAACGGGAAGAAAAGAGTTTTTGCAAC
TTATATTGTCTGTCTGTGTTTAATGTTGCCACTTCTAC
GGGAATTCTGGTTTCTGTAATCCAGGATTAAAGAGC
TGTCAGCTGTTGTACTGTAAATTGTTTGTGTAATAGT
TTTAATTTTTGTAGGGAAAGGACCAAATATGGCCCA
GATTCTCGCTCCTAGCATGCAATGTCAGTTGAAATTC
TCAAAAAGCTCATTAAGCTCGCTAGCATCGAACACG
TGGACCTCCATTTTGCTAAAAGGAAACCAAAAGAGA
TCGCTTCATTGCTCAACTAAGTTCAAGGTATCCGCTG
CTCTCAAATCTGATGATGGTACTATCAACAGGGTAG
AGCAGCTACTCAATTTGGATGTCACTCCATACACTGA
CAAGATTATTGCTGAATACATATGGTATAGTTTCCCA
TTCTGATTTTGGCATCTTTATCGAGGGTTATTTTTTCT
CAAATATGCTTGATGAGGTTATGGTAGAATCAACAT
ATTAGGGCTTTACTTGCATGGTTGTATTAGGCTCTTT
TGTTGTAGAAAAGCCTGCTTGGTAATTCAGTGTCCA
GGTGTTGATGGAACTAATTGAATTATGATTGTTCATT
GGAATAGGATTGGAGGATCTGGGATTGATGTTCGC
AGTAAATCCAGGGTATAGTAACATCCATTCTGTAGC
TTGATTATTAACCACCTATTAGATGCTGACTAATGTT
TTCTTAATAATACCAGACAATCTCAAGACCTATTGAG
GATCCATCTGAACTTCCCAAATGGAACTTTGATGGG
TCAAGCACTGGACAAGCGCCGGGAGAAGACAGTGA
AGTAATCTTATAGTAAGATCCTGTTACATCTATGAAT
CTTCATCATTTTCCCCATAAATTCATTATTCATTATTT
CCGAGTCTTTCTTTTATTCTCGTCTTTTAATGACTGAT
CATTAGTCATTGTTGTCTTGCATTTCTTCTGCAATAG
CCCTCAAGCAATTTTAAGGATCCTTTTCGTGGTGGT
AACAATATCTTGGTGAGTTTGATAGAGCATATGAAT
CGGTTATTCTAAAGTTATAGTGTTTCTTATAAATAGT
AAATTTATTTGTTAAGGTTGCAACCATAATTTATGAT
TTGTAAATCTAGGTGATCTGTGATGCATACACACCA
GCAGGTGAACCCATCCCAACTAATAAACGACACAAA

TABLE 1-continued

Glutamine synthetase gene sequences isolated from various weed species

| SEQ ID NO | SPECIES | TYPE | LENGTH | SEQ |
|---|---|---|---|---|
| | | | | GCTGCACAGATCTTCAGCAACCAAAAGGTTGTTTCT GAGGTTCCATGGTATGAAGTTCCTTGTACTGATAAA ATCCATTTATGAATTGTTAATAACCACTTTGCATTTG AACATTAAATTTTGTGTACAAAGTTTCCTATTATAGG AAGGATAATTAATTAATCATAATTGGGAGGGTGAAA TTGAGAAGAAAAAAGAGGATTGCATGAACAGTCCA ATGCATTTTGTTGCTGACATGAGAGGCAATTTGGGG CTTTGTAGAGCTGGCTGGATTGTGGAATGTAATCGA CAGGAAACTGATGACTGACCACTGTGAATATGATCT GTTATGACACATTTCATTTTTCGAATAGAGGAATTTC ATTGCCAGGTTGACCTATAACAGTATAACTATGTCA GAACAGAGCTTCTCGATTTCAAAATTGTGTTGGCTTT TCATTTTCAAATAATCAGAAGAGACTCATCTTTTGTT TTCTGTGTTATCGTTCTACTTTAAGCTTTTATACTCTT TGTTTTAGTCATTTAATCATATTTTTACAGGTTTGGA ATAGAGCAGGAATACACACTTCTTCAACCAAATGTT AATTGGCCCTTGGGATGGCCTGTAGGAGCTTATCCC GGTCCTCAAGTATGTTATTCAGTTGCTCCTATTTCAT ATTCATTTTGTCCAATGAAGATGCTTTGTTGTGTTAT AGATTAGAATCGTTTTGTTACGCAAAATGATTTTTTT TCGCATTTTCTAGGGTCCATATTATTGTGGTGTTGGT GCTGAAAAATCTTTTGGACGTGACATTTCTGATGCTC ACTATAAAGCTTGCCTGTATGCTGGAATTAACATCA GTGGCACCAATGGGGAAGTTATGCCTGGCCAGGTA TTCCCTTACATCATTCTAGTATGTCTTCCAGTCATAAA TTTTGCTTTGAATCTTGTAACTCAATAGCTGTATATCC ACTTGTACCTACAGTGGGAATTCCAGGTTGGTCCTA GTGTTGGGATTGAAGCAGGAGATCATATCTGGTGT GCCAGATATATTCTTGAGGTATTCTCCTGCAATTTGT ATGTTCCCTCTGCGCTTATCAGTTACAACTATAGTT TTGTAATTTGCTGCCCTATCGTTTTATTATTCATTATT TTTCTACTTGAATTCTGCTTGAAAGATAATAAGCTAC TTTGACACAGACTCGAAGTGAAAGTGACCATATGAG AATCAAACTGACCTTGGAATTATGTGTGATTAACAA CCGAATCTAATCTCTTATGGAAGACATAAATTAATAA TACTTAATAGGCTCCAATGTGGATGACCTCCCGGAA TAA |
| 25 | Kochia scoparia | gDNAContig | 3994 | GTCTATTTTATGAGTAAAACAATTCCCGCTAATTTTC TCCGGGAGATGCTTGCAATCTCAAGAAATTTAATGG TGTGCAATCTACATGTTTGATGGACAAAGTTTTCCCC CAAATTTTAATGGGACATTGGGTAGGTGAAATACTC AATCATTAGTGAAGTACGTAATTGCATTCTAAATCAT TAATTTTTTTAACTCCTTTTGTGACTAAATAAATACTT TTTTTTATCATTTACAATTTTTACTTTGACCGTAATTTTT GACTTATAGATAAGAAAAAATATATTTATCAGAATT CTTGTCGAATTTCTCTCAACTTGTAATTTTTTAAAATC TAATGTTTATAATTTTTGCAAATACATAATTACAGAT ATTAATATAAAAGTTTTATCTCAACATGCGTGAAAA GTACAATTATTATAATAATTTTGTCCCAATAAAATAT TTTTGTTGTTAAAGATTTTTAAGAGGTTGAAAAAGTA GTATATTTTTTTGGCTGAAAAAGAATGGAGAATAA ACAATATCAAAACAATAAATAAAGCAGTATCTAAAA GTAGAGTGTAATTTGTGTAGTCCACTCTTTAAAAGA GTACCAAAAGTTGAGGACTTCCTCATCAATTCATCAT ACCATTTTATATTGGTTGTTTCAGACATCACTCTATAT ATTAGGCGTCATTTTGCGACTCATTTCACGCATTTCT TGATCACATTCTCACAATATCTTTCTTTCTCTCAATAT TTTCCATAAACAATCACAACAACAACATGTCGCTTCT CTCAGATCTCATTAACCTTGATCTTTCTGATTCTACTG ATAAGATCATTGCTGAGTACATATGGTCAGTTCTTTA TTATTGCACACCATCTTTTCGATTTTATTACCCAATGA ATAAAGTTTTATTTTTTCTGGGTTTTTCTCTTTTAGCA GAAAGATTTCATTAACAACTTAATTCACAATGAAGG ATTTCAGCTTTTTTAGTTATGAATAGTTTGATGAAGA AAAGTGATGGGTTGTATCTTATATATTTTATCTGTTT GTTCTTAATATGGGATATTTTCCAGTGTTACAATATT GCTTATTTGACTAGCAAAATATATTTATCTTATTTTTC ATTGAACAAAATATGCACATAATGATTTTCTTTTTAT TGGAAGTCATAGTGTAGTAATCAAGAACTTGCTGTG AATTTATTTTCAGGATTGGTGGATCTGGTATGGACA TGAGAAGTAAAGCTAGAGTGAGTTTTTTTTTTTCTTT TTTTTTTGTTATTGATATTTTTAACCTTAAACCTTCAC CTACCAAAATGAATGAATAAATAAATAAATAAATAA |

TABLE 1-continued

Glutamine synthetase gene sequences isolated from various weed species

| SEQ ID NO | SPECIES | TYPE | LENGTH | SEQ |
|---|---|---|---|---|

ATTTTTGTTTATATTACGAAGTACATTTAAAAAAAAC
AGAGATGATGAGTTTATGATGGTTGGTTTATTGTGT
AGACATTGGAGGGGCCTGTTTCTGATCCGAAAAAGC
TTCCAAAATGGAATTATGATGGATCCAGCACTGGTC
AAGCTCCTGGTGAAGACAGTGAAGTTATTCTCTAGT
ATGTTTTTCTGTTCTCTTTACTTTTGTAATCATTTGAT
GGTTTAAATGAGTCTCTTGGTTGGTATTGGAAATCG
ATGTCTACCCACTCGGTAAATGACCCACCACAGATG
GATAGATAGATTGATAGACAGACGGGAATTATTATA
GTTTAGTCGAAACTACAAGAAGAATCTCTCAAAGCC
ATTAGGTATTAGTCATTGTCTAAAGATATTTGGACCT
ACTCATGTATAGTAATTACTGGTACAAACTTCAATCC
GATGATCATATCATAATTTTTGTGGCCCATGTATTGA
TTTTTGTTGGTTGGAAGGAATGTTTTCTAGCTTCTAT
TTCGCTTTCGTATGGTAACTTATTACTTAAAATAAAG
GACAAGAAAATGATTTTTGATTTTGGAAAGTATCGA
GAAATGTTTTTTGAAAGCTATTTTCTTATGAATATAC
TAAAAATGTGATCTAATCTTTATTAAATAATGCCATA
CTTGTCCACTGAAAATATATTTATTTGGGGGTCAACT
GTTAATTAATTCTTGATCATGGTTGTAACAGCCCACA
AGCTATCTTCAGAGATCCATTCAGGAGGGGAAACAA
TATCCTTGTGAGTTTCGTTGTTACCTATTTTGTTCGTG
ACATCTGTTAGCATCATTGGCTGTTAGTAGGCTAATT
CAGTAATGCTGATGATCACAACTCACAAGTAATAAT
TTGGTGCTGATTTCAGGTTATGTGTGATGCCTACACC
CCACAAGGAGAGCCGATCCCAACTAACAATAGATGC
AATGCCGAAAAGATATTCAGCAACCCAGAAGTTGCC
GCTGAAGTACCTTGGTAAAACTTTAGTCAATGCTGG
CTGGACAATTGTTTCTAGATTTGATAGTTGTAGTGA
ACTTCAGTATTGTGAAATGTATAGGTATGGTATCGA
GCAAGAATATACTTTACTGCAGAAGGATGTAAACTG
GCCCGTTGGCTGGCCTTTAGGCGGCTTTCCTGGTCC
ACAGGTGAATTATTTGAGCTATTATCTAATTTGACTG
CTGTTTTGCAATTTCTTTGCATTAAACTTTGCAACTGT
AAAATTTCACCTGTAAGAAATTACTTAAATACTGTTG
CGTACTTGTTATATTTGTGCCTGTCATTATGTGATGT
TTAAGAATGTTTTCCACTCATAATTTTCCTAGTATTTG
AGTAAAGAAGCTTAAGATAATGATCAGACCACAAA
GAGAATATTGAAAGAAACAGGGGAAGTATGTGTTT
TTGAAAAATATGGACAGGACACAACCAATTAACAGT
CGTTAAAAAAAAATAAAAATCCGTGGGTTAAAAGA
TTTCTGGGACTGCTGACTGTCTAGTCAAATGGTTTGC
TTGGTAATTTGATTTTATTAGAACTTTCTATCGCTCAT
TAAGGATTTGTAACGAAGTGACAATTTTAATGATAC
TTACAGGGCCCATACTACTGTGGTGTTGGTGCTGAT
AAAGCTTTCGGAAGGGACATCGTTGATTCCCACTAC
AAAGCCTGCCTTTATGCTGGAATTAACATCAGTGGA
ATTAACGGTGAAGTGATGCCAGGACAGGTGAATTG
GAAATACCTTTCTATTACTACAAAAAATTGTTATATT
AGTTCGAGTATTGTAATGCATTCTATGTGGCTAATGT
TTTCTTCCTTTTCGTTCCTTAGTGGGAATTTCAAGTTG
GTCCATCTGTTGGAATTTCTGCTGGTGATGAATTGT
GGGTAGCTCGTTACATATTGGAGGTACTTTAAAAAA
AGTTGTCGATTTTATCTTTTCAGACGAATTAAATCT
TACAAATGATTTTGAATGTCAATATGAAACTGTGCAT
TGGTTTTTCTGTTTACAGAGGATTACTGAGGTTGCTG
GAGTTGCTCTTTCATTTGATCCAAAACCCATTCCAGG
TGATTGGAATGGTGCTGGTGCTCACACAAACTACAG
GTGTTTGATTTCTAAACACTTTATCTTAGTCTTATGA
GCTCTTTGTATACAATAATGATTTATTAATAGATCAT
GATCACTAATGCTTGTTAATGTTTATAGCACAAAATC
TATGAGGGAAGATGGTGGTTACGAGGTCATTAAGA
AAGCTATCGAAAAGCTTGGGTTGAAACACGCGGAA
CACATCTCTGCTTATGGTGAGGGAAATGAACGCCGC
CTAACTGGTAAACATGAAACAGCCAGCATTTCAACT
TTCCTGTGGGTGAGTATTTTCTGAATATATTCTCTCC
AATTTGTAACCATCAAACTTCACTTGATCTGCAGTGG
TGCCTTTTGATTTTTGAAGTACTTTTCTTTTGTTTCAA
AGTTGCAAAATTACCTTTTGCACATGATTCCTTTCAT
CTCAGCTTAACGTTTGTGTCCCTCATTTACTCTCTATA
TGGTCCATCTCATCATATCGGCTTTCTTCCTACATATC
CTTTAAAAGAACCGACAGGAAATCTTTAATCCCATAT
GGAGTATATTGTCTTAAAAGAAGAAA

TABLE 1-continued

Glutamine synthetase gene sequences isolated from various weed species

| SEQ ID NO | SPECIES | TYPE | LENGTH | SEQ |
|---|---|---|---|---|
| 26 | Kochia scoparia | gDNAContig | 2204 | ATTAAGGAATGTAAACAGCTCAGATATATTAGACCT AGGCACCTAGCAAGTTATTAAAAATAATGAGCATGC TGGTTGGTTTTTGTAGCACTAAAACAATGAGAGAAG ATGGTGGTTTCGAAGTGATAAAAAAAGCGATTTTGA ATCTTTCATTACGCCATAAGGAGCATATTAGTGCATA TGGAGAAGGCAATGAGAGAAGGTTGACTGGAAAG CATGAAACTGCCAGCATCGATTCATTCTCTTGGGTAT AGTCATTATGCCTTCCCTTTAATTGACATTATATTTAG AGTTATATTTCTCATGAGAGGGTGTTCAACAAACAA TTTGATTATGTCCAGGGTGTTGCCAACCGTGGTTGC TCAATCCGTGTGGGCCGTGATACTGAAAAGGAAGG CAAAGGTAACAATGCTCCTTTTGCCATAACTTACTGT CTTACTTGATATGGCTTGATTTTAGAGTCAGGGTTTA GAAGACTGTCTATATTTTCCTATGAATTTACAATGTA CAACGATTGTTGGATTTTCTCAAAGTTAATTGTTAAC CTAAAAACAAACTAGATGTCTGGTTAAAGAAAATGA ACATGGTACATTTTTTATTTATTTTTAGATGGTTAGA GCTTATCATCCACTTCCGGGAGATCTTGAGATTGATT CTCGCCCTTATGGCTTTCTAAACACCCAGTAAAAAAC AAAGCTATATAACTGAACTACCTCTATATGTTTAAAT TATTAATATTATATTAATGCGGAAGTAACTTGCTTCA AGTTGCATCATAGCATGCGATTTGGCTACTCACATTG TTTAGGGTGTCATCTATGGACTATATGGATTCCCTCA AATGTCTGTAGCTTTACTTCAATTTTCCTATCAAGAC AACAAAAACAAGTTGATTCCTGCTAGACAATGTTTA ATTTCTTGAATATAAATTACTTCGTAAAAAACACATT GTTAATGTTATGATTTAATACTCATCAGGATACTTGG AAGATCGACGACCTGCTTCAAATATGGACCCATATG TGGTAACAGGTTTGCTAGCTGAGACCACAATACTCT GGGAACCCACACTCGAGGCTGAGGCATTAGCAGCT CAAAAACTTGCTCTCAACGTGTAATTCCATCCAAGAC AAACTTAAACAAGAATAAGAAATATTGCATATTGCT GTCTTAAACAACTAAGACAACTTTTCAACTGGATCG AACTTGCTATATTTAGTGATTAGGATTGTTTAAAGCT GTCAAAGCTTTCTCCATATATCTTAGCTTTTCTATGTT TTGTTCATTCAAGGTTTGATGAACAACTATTTGATAT CGTTGCCCTTAATGCGTTTGGTCCCGTTAGTTGCCAA GGCCAATTCGCATCGTGTTTACTACTGAGAGTAGTT GAAATGCGAATTTTATTTGTGTTAATGTATTTGTTGC CAGAAAGTGTCTTGGAAGTTTTGTCAATGGTTTATT GATCTACTTGCTCATGAAGTTGGATGAGACATTTTG CATAATGTGTCTTTTCACTCCCAAACGTGTAGTAATT TGTTCGACTTCCTCATATCACTCGATATCTTTGTGCA AAGTACAAACCCTAAGGGATTAGGGAATTTGTTCTT GTTAACATTTATGGGAAAAAATAATCAACTTTCGTGT TTATTTTATAAATAGTTGTTGTTGTGACAAGTGTAAC GAGATATTTGAAATTAGAGGAACTGGGGTGAACAG GCTCCACTTCAACAATGAATGTTGATTCTCCGACTTG TGCTTGTCAAGACGTTAGAATCAATCTCCGATTCTCT AAGTCTGAAAGCTTGAGCATCCTCCGGATCACCTGA AACAAAAGAGATAATCTAATCGATTATCTCCCTTCGA GTCAACACTTCTACAAAAAAAAAGGTAATAGAGTAA ATAGAGTGACTTAAATGAAATTTTCCTATTTTGTTGA AAAAGTAGGTGAGTTAATGAATGAAAGATTGAGGT GATGTAAAGGAATCTAACTTGAAAAATGTGCAATCA TTGATGGGTATTTATATTGTCTATCAATGATTGTCCT CCTAATGGTTATGCGACATGTGGCATACGCCTATAG GTCACTTGTTATTGGCTAGCCTTAATGACGTGTCG TTTACCGTATTAAATTAATTATGGGATATTTCCCCAT ATACCCCTGAATTTAAGCCTAATAACTCATATACCCT CGTGTTTTTAGAA |
| 27 | Kochia scoparia | gDNAContig | 135 | CCCCTCACATTAGAGAAAATAGCCCAAATATCCTTAA TGAGACCAAAAACCGTGAAATAGTTAACATCGTTAG TATTTTTTCCAATTAACCTCTAATTCAACCTAATTAAC CCATAATCTCATCTCTCTCCTCCA |
| 28 | Lolium multiflorum | cDNAContig | 1673 | CGCGATCTTGCAGTCGCCGACCGTTTCTCCTCCTCTC CCCTCGTCTGCGTCTGCTGCCGCCTCTGCTAGCGTTG ACAAGCAAGGCGGCAGAGTAGCTACCTACTAGCTA GCCTGATGGCGCAGGCGGTGGTGCCGGCGATGCAG TGCCAGATGGGCGCGCTGGGCAAGTCGGCCGTCCG TGCCAGGCCGGCGGCGGCCGGGGGAAGGGTGTGG GGCGTCAGGAGGCCGCCCGCGGCACGGCCGGGTTC |

TABLE 1-continued

Glutamine synthetase gene sequences isolated from various weed species

| SEQ ID NO | SPECIES | TYPE | LENGTH | SEQ |
|---|---|---|---|---|
|  |  |  |  | AAGGTGCTGGCCCTCGGCCCGAGACCACCGGGGTC GTGCAGAGGATGAACCAGCTGCTCGACATGGACAC CACGCCCTTCACCGACAAGATCATCGCAGAGTACAT CTGGGTTGGAGGGTCTGGAATCGACATCAGAAGCA AATCAAGGACGATATCGAAACCGGTGGAGGACCCT TCCGAGCTACCGAAGTGGAACTACGATGGATCGAG CACAGGGCAAGCTCCTGGAGAAGACAGTGAAGTCA TCCTATACCCACAGGCTATATTCAAGGACCCATTCCG AGGAGGCAACAACATCATAGTTATGTGTGACACGTA CACACCACAAGGGGAACCCATCCCTACCAACAAACG CGCCAGGGCTGCACAAATTTTCAGTGACCCAAAGGT TTCTTCGCAAGTGCCATGGTTTGGAATCGAACAGGA GTACACTTTGATGCAGAGAGACGTGAACTGGCCTCT TGGCTGGCCTGTTGGAGGGTACCCTGGCCCCCAGG GTCCATACTACTGCGCCGTGGGATCAGACAAGTCAT TTGGCCGTGACATATCAGATGCTCACTACAAGGCAT GCCTTTACGCTGGAATTGAAATCAGTGGAACAAACG GGGAGGTCATGCCTGGTCAGTGGGAGTACCAGGTT GGACCTAGTGTGGGTATTGATGCTGGAGATCACATA TGGGCTTCAAGATATCTTCTCGAGAGAATCACGGAG CAAGCTGGTGTAGTGCTCACTCTGGACCCAAAACCA ATCCAGGGTGACTGGAATGGAGCTGGCTGCCACAC AAATTACAGCACAAAGAGCATGCGTGAAGATGGAG GTTTTGAAGTGATTAAGAAAGCAATCCTGAACCTTT CACTTCGTCACGACTTGCACATCAGTGAATATGGTG AAGGAAATGAACGGAGATTGACAGGGTTACATGAG ACAGCTAGCATATCAGACTTTTCATGGGGTGTAGCA AACCGTGGTTGTTCTATTCGGGTGGGGCGAGACACT GAGGCAAAAGGGAAAGGATACCTGGAGGACCGGC GTCCGGCCTCAAACATGGACCCATACACTGTGACTG CCCTACTGGCTGAAACCACGATTCTCTGGGAGCCGA CCCTTGAAGCAGAGGCTCTTGCTGCCAAGAAGCTGG CGATGAACGTATGAAGGACTGAAAAGGATGAATTT CTGGGAAAAATAAATCGACAACGACACTGTTTGTCG TCCATTCTTCCTGATCTTGTGGTTCCATCGGGGCACT GTCTGTACAAAATTTACAGTTTGTAGAACCACTTTGC CTTTCGCTTGAACTTCACATTTGATCTGGGTCTGTAT CTGATTCCACTTGGAACTACGTTAAAGGATAATGAA ACACACAGGATTTTGATTCTGCTATTTTATTTCCTTTG AATGGTTCATCTTTAAGACTAGTGTCATG |
| 29 | *Lolium multiflorum* | cDNAContig | 820 | CCAGCCTTCCTCCCTTAATCCTGCTCCTCGCCCTCAGT CCCCACGCCATGGCGCTCCTCACCGATCTCCTCAACC TCGACCTCTCCGGCTCCACGGAGAAGATCATCGCCG AGTACATATGGATCGGCGGATCTGGCATGGATCTCA GGAGCAAGGCCAGGACTCTCCCCGGCCCGGTCTCTG ATCCCAGCAAGCTGCCCAAGTGGAACTACGACGGCT CCAGCACCGGCCAGGCCCCCGGCGAGGACAGCGAG GTCATCCTATACCCACAGGCTATCTTCAAGGACCCAT TCAGGAGGGGAAACAACATCCTTGTCATGTGCGATT GCTACACCCCAGCTGGCGAGCCCATCCCCACCAACA AGAGGAACGCGGCTGCTAAGATCTTCAGCAACCCTG CTGTTGCTGCCGAGGAGCCATGGTACGGTATTGAGC AGGAGTACACCCTCCTGCAGAAGGATATCAACTGGC CTCTTGGCTGGCCCGTTGGTGGGTTCCCGGTCCTCA GGGTCCTTACTACTGCAGTATCGGTGCTGAGAAGTC CTTTGGTCGTGACATCGTTGACTCCCACTACAAGGCT TGCCTCTTCGCCGGCATCAACATCAGTGGCATCAAT GGCGAGGTCATGCCCGGACAGTGGGAGTTCCAAGT TGGCCCAAGTGTTGGCATTTCTGCTGGTGACCAAGT GTGGGTTGCTCGCTACATTCTTGAGAGGATCACTGA GATCGCTGGAGTCGTTGTCACATTCGACCCCAAGCC CATCCCAGGTGACTGGAACGGTGCTGGTGCTCACAC AAACTACAGCACTGAGTCAATGAGG |
| 30 | *Lolium multiflorum* | gDNAContig | 1888 | CCCTTGGTTCCTGAAACTACTTGCACTGTTTGGAAAT GCAGGAAAGAGTTCTACCCAGAAATAAAATTCAAG GACATTATGCAAGCATAATTCTTGGGGAGTAGAAAG CCCTTAAACTGTCTAACCTGGGTCTTAGGTTCTTTAG CTCATTTTACCCATATGGCCATATAACGAATATGGAT GCCATTCTGATGATTTTGAATAGTTCTGGGCCAAATC CACACCCTTGAATTCGCTATTCTGCACCCTCTACGTG TTGAGTGTTATCAATTTGAAAAATGTTCCTTCACTCA TACATATCTAGTCACCAACTGATGGCCTAGCTCACA |

TABLE 1-continued

Glutamine synthetase gene sequences isolated from various weed species

| SEQ ID NO | SPECIES | TYPE | LENGTH | SEQ |
|---|---|---|---|---|
| | | | | GTTGAAAGAAAAATACATTGGCACCAAATTGATATC<br>TTACTATACTATTATCAGTACCCATTCATTATGACAT<br>GGTAATTTGCATGGAGCCATACACTGACAGCGCTGC<br>TGACTGAAACTAAAAGGACTTCATCTTCATGCCAAC<br>AGGATACCTGGAGGACCGGCGTCCGGCCTCAAACA<br>TGGACCCATACACTGTGACTGCCCTACTGGCTGAAA<br>CCACGATTCTCTGGGAGCCGACCCTTGAAGCAGAGG<br>CTCTTGCTGCCAAGAAGCTGGCGATGAACGTATGAA<br>GGACTGAAAAGGATGAATTTCTGGGAAAAATAAAT<br>CGACAACGACACTGTTTGTCGTCCATTCTTCCTGATC<br>TTGTGGTTCCATCGGGGCACTGTCTGTACAAAATTT<br>ACAGTTTGTAGAACCACTTTGCCTTTCGCTTGAACTT<br>CACATTTGATCTGGGTCTGTATCTGATTCCACTTGGA<br>ACTACGTTAAAGGATAATGAAACACACAGGATTTTG<br>ATTCTGCTATTTTATTTCCTTTGAATGGTTCAATCTTT<br>AAGACTAGTGTCATGGGTGGTTCGTCTGTCTCGAGA<br>ATTTATCTATAGCGTTAAAGTTTCTCATGTTTATAAA<br>GCTTTGATGGGGAATGTTGGTGCTATTCCTGCAATT<br>AAATGGATGTGGGATGGTTGTTGTCAACAGAGGCA<br>CAAGGTTTTCTTTTGGCCGCTTGTTCATAATTGCCTC<br>AACACCAGGGCCCTGCTCCAACGAAAGAAAAACACC<br>AGGGCCCTGCTCCAACGAAAGAATTTTGTGATGAAT<br>GATTATTCTTGTGTCATGTGTAATCAGCAGCATCTTG<br>AGACAAGAGATCATCTGTTCTTCCAATGTCCTTTTGT<br>TGTGCTGTGCTGGCAATATCTCTGTCCTCTTTGAATT<br>TCCCTCCTTTGGGGTAGTTTGATCTTCAAGATACATT<br>ATCTGGCCTTAAGCTTGCTATCTCCAAGCCTTTCTTT<br>ATGGAGCTGATAATGTTGATCATATGGTTTATATGG<br>CTCACCCGCAATGATTTTATCTTCAAGGCTGTTCCTC<br>CAATGATTTTATCTTCAAAGCTGTTCCTCCAAGTGTT<br>TACAGATGTCGGAAGAGATTTAAGGATGGGCTTGC<br>CCTTCTAGTTCACAAAGCGAAGAGAAAATCTTATCA<br>TGGCATAGTCACTTGGGTGGAAATTTTAGATAGCCT<br>TTGCTTTCTCTTTGGGCTTATGGCCTCTTTTATTTGCT<br>CCTCTCAAGCAACTGTTCTCTTTTGTAGACCTTTTAA<br>GCCTTTATAAATAAAATAAAAAATATACAGTGGGGA<br>AACTCACTGTTTAGCCTAAAAAAAGAATTTATCTATA<br>GCCATACCAATATAATGCCATGATACTAACACAAGT<br>TAAAAATCAGTGGCGAAGCTAGAGATTCTGACCAGT<br>AGGGCCAGTTATCTTGTTTATGGTGTAATTTTTCAGT<br>AATGAGCAATGTAAAGAACCACATCAATGAAGATTT<br>CTGAATTTCTACTGGGTTCGTTTGAACACGAGAACT<br>GTATGCAAGCTCTACCCTGTGAAAATAATCA |
| 31 | Lolium multiflorum | gDNAContig | 1737 | TGAAATTATTGCAAACAGATGACGCTCCTAAAACCG<br>GTAATCTGGGCCTCCAATTATTGGTGCGCCTGGTCA<br>GAGCCTTCCAAGTTCCAAAACTATGAATGGAAAACA<br>ATAACAATGGCCATGCCGGTCAATCACTGTACATAT<br>AAACAACCCAGGCCGTTGAGGTTTGGCTGTTGCTCG<br>TGTTTATTTTGATTGGAGAGGTCGCCTGGGCTTGGC<br>CGGCTCGCATGTGGAGACGGACGTGACAAGGAGAG<br>GCAGCCGCATCTTTCATATCCAGAGCACAAAAACAC<br>ATTGTAAACTCTATCCAAGATGTGTGTGCCTGCCTTC<br>TGAGCGGCGCTTCCCTTTGCTGTCTTTGCCTCCGGTG<br>GTGCTGCAAGGGCCGCCAGAAATCTCGTCCACCCAA<br>AGCCCTATCGCCTAATCAAGAGCCAGATGCCACTGC<br>CCCAGCCGCGGCCACTAGAATCTCTCTCGCAAATCT<br>AAAATACTTATACGCCTCTTGCTCTGCCCCCGTAGAT<br>AGATAAATAATTCCAGCGCGATCTTGCAGTCGCCGA<br>CCGTTTCTCCTCCTCTCCCCTCGTCTGCCCGTCTGCTG<br>CCGCCTCTGGTGAGTGGTCGAACCAATGCCTAGTTT<br>CGTTCCTTCTCTGTTGCATTCGCTGCTGGCTAGTGAT<br>CGATCCGATGTGGTAATGGCGCCTATCTGCTTTGGT<br>TGGTTGATCAGCTAGCGTTGACAAGCAAGGCGGCA<br>GAGTAGCTACCTACTAGCTAGCCTGATGGCGCAGGC<br>GGTGGTGCCGGCGATGCAGTGCCAGATGGGCGCGC<br>TGGGCAAGTCGGCCGTCCGTGCCAGGGCCGGGGA<br>AGGGTGTGGGGCGTCAGGAGGGCCGCCCGCGGCA<br>CGGCCGGGTTCAAGGTGCTGGCCCTTCGGCCCGGAG<br>ACCACCGGGGTGGTGCAGAGGATGAACCAGCTGCT<br>CGACATGGACACCACGCCCTTCACCGACAAGATCAT<br>CGCAGAGTACATCTGGTACGTACGTCCTCCCAATGT<br>TGCATTCCTCGGTTGCGCCGGAGCGGGCTTTGTTCG<br>CTTCCGTTGACTCCCCACGACAGAACACCACCAGTA |

TABLE 1-continued

Glutamine synthetase gene sequences isolated from various weed species

| SEQ ID NO | SPECIES | TYPE | LENGTH | SEQ |
|---|---|---|---|---|
| | | | | GCTTCAGATAGGCCAAACCCGCACTTTTTGGGACTA GATTAGTGCCGGGGCAAGCAGATTCGCCCCCCTTTT AAGGTTTGATGATAGTGGTTATTTAATTTTCTGTCTA AAGCTTCCTGGGCATGGTGGGTGATGAGTGACGAA TTCAAAAGTGCTTGCTTTTTAGTTAGTTCCAGCACTT GAATAAGCTTAGGAAAATGCACATCGCACTTTGGGG GAGCAATAAGGGTCAAACAAATTGGTCCTGGCATCT ACTAAGTACTAGTACCTCTGTGGCAAAATATAAGAC GCTTTGGTAGCCTATTTTTGGGACACATGTAATATTA CTAGTATTTTAACAATTCTGCCTTTCTCTCTTCACATT CCGCAGGGTTGGAGGGTCTGGAATCGACATCAGAA GCAAATCAAGGGTACGCAGCCCATTATATTCATGAA ATTGACATTAGATTTGTTTTTTTTTTGAAAGGATTTT TTTTCTAGAAGTTTAGCGGATGAGAAGTTGGTTTTGT ATGCAGAGTTCTCCTTCCTTACATCCTTTTTGGTTCCT GACAAGAAAATTTAATGCTTGCATTTCAGACGATAT CGAAACCGGTGGAGGACCCTTCCGAGCTACCGAAA TGGAACTACGATGGATCGAGCACAGGGCAAGCTCC GGGAGA |
| 32 | Lolium multiflorum | gDNAContig | 975 | ATGACCAGAATATGGTCAATAAAGCAATTGGTTGGT TAACCCTTTAGCTGCATGCACTATGAACTTGTGATTT GTTCGAAACTTCAGTTTTAATTCATTTCCTGAAAACC GTCAGACCATTTTTCTTCAAAATATGATGAAACCAAA TCCTATAACTGGCCAGCCCTTTGGTCAAATCATATTT CCCATCTGTAAAGCCTTCTAATTATCATCGTACTGAC CTTAATCAGAGAATCACGGAGCAAGCTGGTGTAGT GCTCACTCTGGACCCAAAACCAATCCAGGTATATCC CTGTAAGTTGTTGGAAGCACTTTATATATTGAAACTT AGTAAACTGAAGATTAATTTGATATAGGGTGACTGG AATGGAGCTGGCTGCCACACAAATTACAGGTTCCAA TCTCTTCTGTTAAATAATGCATTTTTCCTGCTTAACAT TTACAGAATATCTTATTGTATATTAACAATACATCAG AAAACCTAATATAGCTTTGCTTTAGTAAATGCTGTGG GGTTCACATCAGAAGGAAATGTATGCTGGGACTAAT AGAAAAAACCCCTCCAAATACAAATTTAAACTGGCT ATAAATGGGAAACCATTATTAGTCGTCGGTTTTTTAT TGAGCATGATTCAGAATAAGCATTTATTCACATTAGT TAATCGCTAAATTTGGTTAGTTGTTTTTCTCAATACTC GATACAGTTTGTCCTTAATGTGCAAGTGAGAAACTA TCTTTTCTTGTTGTTGCAAATATAGCACAAAGAGCAT GCGTGAAGATGGAGGTTTTGCAGTGATTAAGAAAG CAATCCTGAACCTTTCACTTCGTCACGACTTGCACAT CAGTGAATATGGTGAAGGAAATGAACGGAGATTGA CAGGGTTACATGAGACAGCTAGCATATCAGACTTTT CATGGGTACGGGTGGAGCAGCCTTTCATTATTTTTC AGCTGTAATTTACTTCATGTTTATTT |
| 33 | Lolium multiflorum | gDNAContig | 781 | CCACTTGCATTATTCATTTCTGGTTTTGCTTTTATGCA GCTATACTGAAAGGGTCAATAGTGGACACTTTTACC TGTTTGTTACATGTGCCAAGTGCCATGTGAGTTAAA ATGATTTTTTTTTTGCCTTTCAGGTTATGTGTGACAC GTACACACCACAAGGGGAACCCATCCCTACCAACAA ACGCGCCAGGGCTGCACAAATTTTCAGTGACCCAAA GGTTTCTTCGCAAGTGCCATGGTAATTATGCGTTGA GCACCTGTATGCCGTGCAAAGGCCTGCTGTTCTTTTA CCTCCCTTTATTCGCCTGCAGACTATAGAGTTGAAAA ATCTTCTTTTCTAGGTTTGGAATCGAACAGGAGTACA CTTTGATGCAGAGAGACGTGAACTGGCCTCTTGGCT GGCCTGTTGGAGGGTACCCTGGCCCCCAGGTACTGT ACCAAGAAGCTTCATTTACTATTCAAAAAATAAATCT TAGGCTGGCTGAAATACACTTTTTAGTTAAACACTGT TGAGTAGTAATATTGTGCTGAAATATTGCAGGGTCC ATACTACTGCGCCGTGGGATCAGACAAGTCATTTGG CCGTGACATATCGGATGCTCACTACAAGGCATGCCT TTACGCTGGAATTGAAATCAGTGGAACAAACGGGG AGGTCATGCCTGGTCAGGTGAGCCTTTGTGTTTATA CGTGCGCACGTATACTTATCTTGTGTGAACCCGAAC CAGAGATGTTTTTACATTTTCTTTCTAATGAAGTGT TTAATAAGTGGAATTT |
| 34 | Lolium multiflorum | gDNAContig | 766 | CAAACATTAGATGCTCTACGATTAGGTGTTGGAGAT TATAATCGGGATACAGGTATGTATGGGATGATGTCT AATTATCATATGGTGCTGACTATGAAAGTATGAGGA |

TABLE 1-continued

Glutamine synthetase gene sequences isolated from various weed species

| SEQ ID NO | SPECIES | TYPE | LENGTH | SEQ |
|---|---|---|---|---|
| | | | | ATAATGCTAGATATTTTGCATCAGATGAAAAGTACA AATATAAATAATTTCCAACGTAAGAGCTAAGAAAAA CATTAGAAATTCAGTTCCTGGAAAAGAAAAGCTACT ACCAGGAAAGTGATCAGAGCATTTGGCACCTTTGTA TCCACTTTCCTGCCTTATCTGTTTTATGATAGCACTAG CACACACAGTAGGCTTATCTCTGAATCCAAAAACAG GTACGGTATCGAGCAGGAGTACACCCTCCTTCAGAA GGACGTGAACTGGCCCCTTGGCTGGCCCATTGGTG GCTACCCTGGTCCTCAGGGCCCCTACTACTGCGCCG CCGGTGCGGACAAGGCGTTCGGCCGTGACATCGTT GACGCTCACTACAAGGCCTGCCTCTACGCCGGGATC AACATCAGCGGCATCAACGGGGAGGTCATGCCCGG CCAGGTACTACACATCCTCTTGCAGCAACTTGGTTTC TGTCTTGTCAGAAACACTTCTAACGGTGATATGGCT GATGCGTGTGCCGCCAACTCTGACTGTGAACCTGAT TCCTGTGTGACAGTGGGAGTTCCAAGTTGGCCCGTC CGTTGGGATCGCCGCCTCCGACCAGCTCTGGGTGGC CCGCTACATCCTCGAGGTCAGTGCCCTCCGAACATA TTCGATTCTC |
| 35 | Lolium multiflorum | gDNAContig | 575 | GTACACACCACAAGGGGAACCCATCCCTACCAACAA ACGCGCCAGGGCTGCACAAATTTTCAGTGACCCAAA GGTTTCTTCGCAAGTGCCATGGTAATTATGCGTTGA GCACCTGTATGCCGTGCAAAGGCCTGCTGTTCTTTTA CCTCCCTTTATTTGCCTACAGACTGTAGAGTTGAAAA AACTTCTTTTCTAGGTTTGGAATCGAACAGGAGTAC ACTTTGATGCAGAGAGACGTGAACTGGCCTCTTGGC TGGCCTGTTAGAGGGTACCCTGGCCCCCAGGTACTG TACCAAGAAGATTGATTTACTATACAAAAATAAAGC TTAGGCTGGCTGAAATACACTTTATTAGTTAAACACT GTTGAGTAGTAATATTGTGCTGAAATATTGCAGGGT CCATACTACTGCGCCGTGGGATCAGACAAGTCATTT GGCCGTGACATATCAGATGCTCACTACAAGGCATGC CTTTACGCTGGAATTGAAATCAGTGGAACAAACGGG GAGGTCATGCCTGGTCAGGTGAGCCTTTGTGTTTAT ATGTGCGCACGTATACTTATCTTGTGTGAACC |
| 36 | Lolium multiflorum | gDNAContig | 455 | GTATTTAACAATTCTGCCTTTCTCTCTTCACATTTCGC AGGGTTGGAGGATCTGGAATTGACATAAGAAGCAA ATCAAGGGTACGCAGCCCACAATCTTCATGGACTTG ACATTATATATATTTTTTTAAATGATTTCTTTTCTAGA AGTTTAGGGGATGGGAAGTTGGTTTTGTACGCAGA GTACTACTTCCTTACTACCTTTTCGGCTCCTGACAAG AAAATTTAATGCCTGCATTTCAGACGATATCGAAAC CGGTGGAGGACCCTTCCGAGCTACCCAAGTGGAACT ACGATGGATCGAGCACAGGGCAGGCTCCTGGAGAA GACAGTGAAGTCATCCTATAGTAAGGGGGAAATTG CAGTATATGTGTTCTTCATCCTTGCATATAAGAAGTA TCCTAGATTTATACATGTGTTACTCTCTTTATGTTTTT CGTATCCTGTTTCAGCCCA |
| 37 | Abutilon theophrasti | cDNAContig | 1270 | TTTTCCCCTCTCTTTCTTCTTAGTTTCGCTGTTGTTCAA TATGTTGCTCCTCAATGATCTCATCAACCTCGACCTC ACCGAGACCACCGAGAAGATCATAGCCGAATACAT ATGGATCGGTGGATCTGGTATGGATTTGAGAAGCA AAGCAAGAACTTTGCCTGGACCGGTGTCGGACCCTG CAAAACTTCCGAAATGGAACTACGATGGTTCAAGCA CAAATCAAGCTCCTGGAGACGATAGTGAAGTGATTC TATATCCTCAAGCTATATTCAAGGATCCATTCAGAAG AGGAAACAACATCTTGGTGATGTGCGATGCTTACAC ACCAGCCGGTGAGCCCATTCCCACGAACAAGAGATA TAATGCAGCCAAGATATTTAGCAACCCTGATGTTGTT GCCGAGGAACCATGGTATGGCATTGAGCAAGAGTA CACTCTTCTTCAAAAGGATACCAAGTGGCCTCTTGG ATGGCCTGTTGGAGGATTTCCAGGACCACAGGGCCC CTACTACTGTGGAGTAGGAGCTGACAAGTCCTTTGG CAGGGACATTGTGGATTCCCACTACAAGGCTTGCCT TTATGCTGGCATTAACATCAGTGGAATCAACGGTGA AGTTATGCCCGGTCAATGGGAGTTCCAAGTTGGTCC AGCGGTTGGAATATCTGCGGGTGATCAAGTATGGA TGGCTCGATACATACTCGAGCGAATCACCGAAATTG CAGGAGTGGTTCTTTCTTTCGATCCCAAACCCATTCC GGGTGACTGGAATGGTGCTGGTGCTCATACCAACTA CAGCACAAAGTCCATGAGAAATGATGGCGGCATCA |

TABLE 1-continued

Glutamine synthetase gene sequences isolated from various weed species

| SEQ ID NO | SPECIES | TYPE | LENGTH | SEQ |
|---|---|---|---|---|
| | | | | AAGTTATCAAGGAGGCGATTGAGAAGTTGGGTAAG CGCCACAAGGAGCACATTGCCGCCTACGGTGAGGG TAACGAGAGACGCTTAACTGGTCGTCACGAGACTGC TGATATCAACACATTCTCTTGGGGTGTGGCAAACAG GGGAGCCTCCATCCGTGTTGGCCGTGACACCGATAA GGACGGAAAAGGCTACTTCGAAGACAGAAGGCCGG CATCAAACATGGATCCTTATGTCGTGACATCGATGA TTGCCGAGACCACCATTATATGGAAGCCTTGAGAGG TGAAAATTGGAGCTTGCGGATGATGAGAAAGAAAA TCCTACATTCATATTAATAACCCCTTCTCTCATCTTCT TTGTTGTGCCAGTGGTTGAACTTGTAGTTTTATTGCT TTGGATTTGCTGGTTTGCCATTAAAATTCTGCCCGTC TTTTTTTT |
| 38 | Abutilon theophrasti | gDNAContig | 1252 | AATTTTCAATCTGTTGTCTAGTTTGTTTTATCTTATGT TCTTTTGGACGTTCTTCCAACCTTCAGACAATAGCAA AGCCAGTTGAGCATCCCTCTGAACTTCCCAAGTGGA ACTATGATGGATCAAGCACCGGTCAAGCACCTGGTG ATGACAGTGAAGTTATTTTATAGTAAGATCTTTAATG AAAACTAAAACTTCCTTTATTGCTTGTTTTCATCAAA ACACTATTTGACTGAAAATTTTATCCAGCCCTCAGGC AATCTTTAAGGACCCTTTCCGAGGAGGTAACAATAT CTTGGTGAGTATTAACAAAGGCTTATAATTGAAAAT TTCTGATGAATTGTTGAAATTTTTGTGGGTAAATTAT ATAGTGTGGTTAACATTTTCATGCATGTTTCCCATAG GTTATTTGTGATGCATACACACCGGCTGGTGAGCCC ATTCCAACGAACAAGCGCCACAAAGCTGCCGAGATT TCAGTAACAAGAAGGTGATAGATGAAATACCATG GTACGAATTACTTTATTGTAACTATCTTATTCTTTTGT TCAAATCTGGATTAATTGAGAATTATATTGTAATCTT GTGTTCGCTTTATTCTATCTCGGCATTCATACAAAAG GAAATGCCCTCATTTTGTTGTACTATTCTGTTAAGGT TTGGGATTGAGCAAGAGTACACCTTACTTCAACAAA ATGTAAAATGGCCTTTGGGTTGGCCTGTTGGAGGCT ACCCCGGTCCTCAGGTAATAATATGACTCGATTTTTA TACAGGAGTAAATTGGTTGTAGGGGGTCTGTAAATT CTTGCTAATAACATAGTCCTACTTGAACTTATACTTG AATGTGGTTGTTTGATGCCAAATTCAGGGTCCTTATT ACTGTGGAGCTGGAGCTGACAAGTCATTCGGGCGT GACATCTCAGATGCTCATTACAAGGCTTGCTTATATG CTGGCATCAACATTAGTGGCACCCAATGGGGAGGTT ATGCCCGGCCAGGTCTGCTGCCTTTGAGTCCTCATCT TGCTAATGAAAATGAAGTGCTATTGCAGTCATGTTT GTTTGTGTATTAGGTATCACCATTTGATTCTGTAAAT TACTATGCAGTGGGAGTATCAAGTTGGTCCAAGTGT TGGTATTGAGGCTGGAGATCATATCTGGTGTTCTAG ATACATTCTTGAGGTATTTATTCTCACATGATTTGGT TAATCTTATGGAGGCCGCTGCAAAATTCCAGCCTTC GCACACATAG |
| 39 | Abutilon theophrasti | gDNAContig | 885 | TGGATGGCCTCTTGGTGGCTATCCTGGACCTCAGGT ACTCCCATCTTTCTTTCTTTCAAAAGCAATGTTTAAAT GTTGGATGATATATATATCGGACTGGACGGAGAGC CGATTTGTTCAACCAATCGGTGAATATGTAACCCTG ATTCGGGTGAATATTTTGTTGATAGGGTCCCTACTAT TGTGGTGTTGGTGTGGACAAAGCCTATGGGCGTGA CATTGTGGATTCTCACTACAAAGCTTGTTTATATGCT GGAATCAATATCAGTGGCATCAATGGAGAAGTGAT GCCAGGGCAGGTAAAAATGACTGGTTTTTTACTCTT TTATGCTTCTCTCGGTTATTGGTTATGTTAAAGCTTA ATCTATCTTCTATTTTCTTTACAGTGGGAATTTCAGG TCGGTCCATCACTTGGCATCTCTGCTGGAGACGAAT TGTGGGTTGCACGTTACATTTTGGAGGTAATCAACC TATGTTACTCTCGAACTTGAGTGTCGTAGTTTTTAAA GGTTCTTCATGTGTTTGGTTATCCTTGGTCATATCTA TCAACCCCACATATACTCGAACAAGAATGAAAAATC GAAGCAACATAGTTATCGAGGGTTTCACTTCGACTC TCTTCAGTTATTTTAATCTATGTTTCTGAAATACAGA GGATTACCGAGATTGCTGGAGTGGTGCTCTCCTTTG ATCCTAAGCCAATTCAGGTTCGAATTGCTGGTTCCAT TAGCCTTTTCTTTTGCTCCGGATAGACTCGAAATCTT AAGCTTATTACAATTTTGTTTTAACTTTGATCCCAGG GAGACTGGAATGGTGCTGGTGCTCACACAAACTACA |

TABLE 1-continued

Glutamine synthetase gene sequences isolated from various weed species

| SEQ ID NO | SPECIES | TYPE | LENGTH | SEQ |
|---|---|---|---|---|
| | | | | GGTACCATTTGAATCTACTTCAAGAAGTTGGTGGAG GAACTGAATGAT |
| 40 | Abutilon theophrasti | gDNAContig | 1075 | GTATGGATGGCTCGATACATACTCGAGGTATGATCT GTATACTATAGTGTATTTGATTAATGAATTTTTACCT CTTTAAGGATTGAAGTTTAACTAATAAACTTCTGTTT TTCTTGTTTTAAACAGCGAATCACCGAAATTGCAGG AGTGGTTCTTTCTTTTTGTATCCCAAACCCATTCCGG TTTGTTTTTCTATGCTACATTTTCTCCTATATTCAACTT TATATCGCCTTTTATGTTCTTTTTCCCCTTTTTTCTCGT CCTGCCTCTTTAACTTTTCATCTTTGCATTTCATTTCG ATAACTAGGGTGACTGGAATGGTGCTGGTGCTCATA CCAACTACAGGTAGATACTAAACTCATTGTGCACTTC ACTTTTATAAAGTATATAATATATACCCTTTTGCATG GATGAAGAGTTAATTAGTTGAATTGAAACTCTCTCA GCACAAAGTCCATGAGAAATGATGGCGGCATCAAA GTTATCAAGGAGGCGATTGAGAAGTTGGGTAAGCG CCACAAGGAGCACATTGCCGCCTACGGTGAGGGTA ACGAGAGACGCTTAACTGGTCGTCACGAGACTGCTG ATATCAACACATTCTCTTGGGTAAGTTTGAACAATTG TAGGCCTATAGCATCCCCTTTCCAACAAGCTAGAAT GGTATTGAATTCTCTTATGGTTAAACATCTCCATTTT CTAATTTCTTGTTGCTGTTTTGATTGCCATGTCCAAA CTCCAGGGTGTGGCAAACAGGGGAGCCTCCATCCG TGTTGGCCGTGACACCGATAAGGACGGAAAAGGTT AGCACTATGCAGATATTGATCAAACTTCGATTCTAAT ATGAACCTCCATTTTTTTCTCATTCCTTGAATTTTAAC ATTCATGGTCATGTAATTCGCAGGCTACTTCGAAGA CAGAAGGCCGGCATCAAACATGGATCCTTATGTCGT GACATCGATGATTGCCGAGACCACCATTATATGGAA GCCTTGAGAGGTTAAAATTGGAGCTTGCGGATGAT GAGAAAGAAAATCCTCCATTCATATTAAAAAACCCC TCTCTCATCTTCTTTGTT |
| 41 | Amaranthus albus | cDNAContig | 1603 | TTCTTTATCTCTCTATATTCATCTCTCTCTAGCTTAT TCACGACGCCGATCACCCTTTTCCGAACCCAGGTAA AAGTGACCAAACATGGCACAGATACTTGCACCTTAC ATGCAATGTCAGCTGAAGTTCTCAAAAGGTTCAACA AGTTCAATGACATCAAATCCTTGGACTTCAATATTTC TTAAAGAAAATAAAAAGGGATCAATTAAATGCTCGA GTAAGTTCAGAGTATGTGCTTCTCTCCAATCTGAAAA TAGCACAATAAACAGGGTGGAGCAGCTACTCAACTT GGATGTCACTCCATACACTGACAAGATAATTGCAGA GTACATTTGGATTGGAGGATCTGGTATTGATGTCCG TAGCAAATCAAGGACTATCTCTAAACCTGTTGAGCA CCCATCTGAGCTTCCCAAGTGGAATTATGATGGCTC AAGCACAGGACAAGCACCAGGAGAGGACAGTGAA GTAATCTTATACCCTCAAGCAATTTTCAAGGATCCAT TCCGTGGTGGTAATAATATCCTTGTAATCTGTGACAC ATACACACCAGCAGGCGAACCCATCCCCACTAATAA AAGATACAGGGCTGCACAGATATTCAGCGACCCAA AGGTTGTTTCTGAGATTCCATGGTTCGGAATAGAGC AGGAATACACTTTGCTCCAACAAAATGTTAAATGGC CTTTGGGATGGCCTGTGGGAGCCTATCCTGGTCCTC AGGGTCCATACTATTGTGGTGCTGGTGCTGACAAAT CTTTTGGACGTGACATATCTGATGCTCATTACAAAGC TTGCTTGTATGCTGGTATTAACATTAGTGGCACAAAT GGGGAAGTTATGCCTGGCCAGTGGGAATTCCAAGT TGGTCCAAGTGTTGGCATTGAAGCTGGAGATCATAT CTGGTGTGCTAGATATATTCTGGAGAGAATTACTGA ACAAGCTGGTGTGGTTCTAACTCTTGATCCAAAGCC TATTGAGGGTGATTGGAATGGTGCAGGTTGCCATAC AAATTACAGTACAAAGACCATGAGAGAAGATGGTG GTTATGAAGCAATTAAGAAGGCAATTTTGAATCTAT CATTACGTCACAAGGACCATATCAGTGCATATGGAG AAGGAAATGAACGAAGATTGACAGGGAAGCACGA GACCGCCAGCATCGACACATTCTCTTGGGGTGTTGC CAATCGTGGTTGCTCTATCCGTGTGGGTCGTGACAC GGAAAAGGCAGGCAAAGGTTATCTGGAAGATAGGC GGCCTGCTTCAAACATGGACCCATACGTGGTAACAG GTTTGCTCGCAGAAACTACAATACTTTGGGAACCAA CACTTGAGGCTGAGGCACTCGCAGCCCAAAAACTCG CTCTTAATGTGTAATTCAATCATAAATCGTACGAGAA TATCGCATATTCTTGAGGGAGGAACTGTTTCACGAG |

TABLE 1-continued

Glutamine synthetase gene sequences isolated from various weed species

| SEQ ID NO | SPECIES | TYPE | LENGTH | SEQ |
|---|---|---|---|---|
| | | | | CCCCGAATTTGCTTGTTTTTAGTTTTTAGTATCCTGG GACTGGGACTGGGTATGTATTTCTTGACCTTTGCTTC TGGTCGTTTGTTTTGGGAGTTAGAAGAGAAGAATAG TTTGTGATTGTTACCTATTTATTTTTGCTCTTATGAAG CTCAAGCTCAGCA |
| 42 | Amaranthus chlorostachys | cDNAContig | 514 | CTCTCTAGCTCACCCTTTTCCGAACCCAGGTATAAGT GATCAAACATGGCACAAATACTTGCACCTTACATGC AATGTCAGATGAAGTTCTCAAAAGGCTCAACAAGTT CAATGACATCAAATCCTTGGACTTCAATATTTCTTAA AGAAAATAAAAAGGGATCAATTAAATGCTCTAGTAA GTTCAGAGTATGTGCTTCTCTCCAATCTGAAAATAGC ACAATAAACAGGGTGGAGCAGCTACTCAACTTGGAT GTCACTCCATACACTGACAAGATAATTGCAGAGTAC ATTTGGATTGGAGGATCTGGTATTGATGTTCGTAGC AAATCAAGGACAATCTCTAAACCTGTTGAGCACCCA TCTGAGCTTCCCAAGTGGAATTATGATGGCTCAAGC ACTGGACAAGCGCCAGGAGAGGACAGTGAAGTAAT CTTATACCCTCAAGCAATTTTCAAGGATCCGTTCCGT GGTGGTAATAATATCCTTGTAATCTGTGACACATAC ACACCAG |
| 43 | Amaranthus chlorostachys | cDNAContig | 1140 | TACAGGGCTGCACAGATCTTTAGCGACCCAAAGGTT GTTTCTGAGATTCCATGGTTTGGAATAGAGCAGGAA TACACGTTGCTCCAACAAATGTTAAATGGCCTTTG GGATGGCCTGTTGGAGCCTATCCTGGTCCTCAGGGT CCATACTATTGTGGTGCTGGTGCTGACAAATCTTTTG GACGTGACATATCTGATGCTCATTACAAAGCTTGCTT GTATGCTGGCATCAACATTAGTGGCACAAATGGGG AAGTTATGCCTGGCCAGTGGGAATTCCAAGTTGGCC CAAGTGTTGGTATTGAAGCTGGAGATCATATCTGGT GTGCAAGATATATTCTTGAGAGAATTACTGAACAAG CTGGTGTGGTTCTGACTCTTGATCCAAAGCCTATTGA GGGTGATTGGAATGGTGCAGGTTGCCATACAAATTA CAGTACAAAGACCATGAGAGAAGATGGTGGTTATG AAGCAATTAAGAAGGCAATTTTGAATCTATCATTAC GCCACAAGGACCATATCAGTGCATATGGAGAAGGA AATGAACGAAGATTGACAGGGAAGCACGAGACCGC CAGCATCGACACTTTCTCTTGGGGTGTTGCCAATCGT GGTTGCTCTATCCGTGTGGGCCGTGACACAGAAAAA GCAGGCAAAGGTTATCTGGAAGACAGGCGGCCTGC CTCAAACATGGACCCATACGTGGTGACAGGTTTGCT CGCAGAAACTACAATACTTTGGGAACCAACACTTGA GGCTGAGGCACTAGCAGCCCAAAAACTCGCTCTTAA TGTGTAATTCAACCATAATCGTGCCAGAATATCGCAT ATTCATGAACGAGGGAACCCTTTCACGTGCCCAGAA TTTGCTTATTTTTAGTTTTTAGTATCCTGGGTATGTGA GTGTTTTCATTCATGACCTTTGCTTCTGATCATTGTTT GTTTTGGGAGTTCAAGAGAAGAATAATTTGTAACTG TTGCCTTCATTATTTTTGCTCTTATGAAGCTCAAGCTC AGTATTAGTTATATTCCAGATTAAGGAATGAACTTCA AAATCCTTTGTTACTCATCTTCAACTCCATTGAATATA CACTTATGTCCCTTTAGTTTGCTACAATTACACTATG ATTACAAATTTACA |
| 44 | Amaranthus graecizans | cDNAContig | 1691 | CATTATTCCATTCTACCCATACTTGGGACAATCATAC CTTTATAACACCTTTAACCATACACACTCTCTCTTCTT TATCTCTCTAAATTCTTCACTCTCTCTCTAGTTAGTTG ACGCCGCCGACCACCTTTTCCGAACCCAGTGACCAA TTATGGCACAGATACTTGCACCTAACATGCAATGTC AGATGAAGTTCTCCAAAGTCTCGACAAGTTCAATGA CATTAAGTCCTTGGACTTCCATATTTCTGAAAGAAAA CCAAAAGAAATCGATTAAATGCTCTAGTAAGTTCAG AGTATGTGCTTCTCTCAAGTCTGAAAACAGCACTGT AAACAGGGTGGAGCAGCTACTCAACTTGGATGTCAC TCCATACACTGACAAGATTATTGCGGAGTACATTTG GATTGGAGGATCTGGTATTGATGTCCGTAGCAAATC AAGGACTATCTCTAAACCTGTTGAGCACCCATCTGA GCTTCCCAAGTGGAATTATGATGGCTCAAGCACAGG ACAAGCACCAGGAGAGGATAGTGAAGTAATCTTAT ACCCTCAAGCAATTTTCAAGGATCCATTCCGTGGTG GTAATAATATCCTTGTAATCTGTGACACATACACCCC AGCAGGCGAACCTATTCCCACTAACAAAAGATACAG GGCTGCACAGATATTCAGCGACCCAAAGGTTGTTTC |

TABLE 1-continued

Glutamine synthetase gene sequences isolated from various weed species

| SEQ ID NO | SPECIES | TYPE | LENGTH | SEQ |
|---|---|---|---|---|
| | | | | TGAGGTTCCATGGTTTGGAATAGAGCAGGAATACAC<br>TTTGCTCCAACAAAATGTTAAATGGCCTTTGGGATG<br>GCCTGTGGGAGCCTATCCTGGTCCTCAGGGTCCATA<br>CTATTGTGGTGCTGGTGCTGACAAATCTTTTGGACG<br>TGACATATCTGATGCTCATTACAAAGCTTGCTTGTAT<br>GCTGGTATTAACATTAGTGGCACAAATGGGGAAGTT<br>ATGCCTGGCCAGTGGGAATTCCAAGTTGGTCCAAGT<br>GTTGGCATTGAAGCTGGAGATCATATCTGGTGTGCT<br>AGATATATTCTGGAGAGAATTACTGAACAAGCTGGT<br>GTGGTTCTGACTCTTGATCCAAAGCCTATTGAGGGT<br>GATTGGAATGGTGCAGGTTGCCATACAAATTACAGT<br>ACAAAGACCATGAGAGAAGATGGTGGTTATGAAGC<br>AATTAAGAAGGCAATTTTGAATCTATCATTACGTCAC<br>AAGGACCATATCAGTGCATATGGAGAAGGAAATGA<br>ACGAAGATTGACAGGGAAGCACGAGACCGCCAGCA<br>TCGACACATTCTCTTGGGGTGTTGCCAATCGTGGTT<br>GCTCTATCCGTGTGGGTCGTGACACGGAAAAGGCA<br>GGCAAAGGTTATCTAGAAGATAGGCGGCCTGCCTC<br>AAACATGGACCCATACGTGGTAACAGGTTTGCTCGC<br>AGAAACTACAATACTTTGGGAACCCACACTTGAGGC<br>CGAGTCACTTGCAGCTCAAAAACTCGCTCTTAATGT<br>GTAATTCCAACCATAAAACGAAGCAGAATATCTCAT<br>ATTCTTGAGGGAGGGAACTGTTTCACGAGCCCCGAA<br>TTTGCTTGTTTTTAGTTTTTAGTATCCTGGGACTGGG<br>ACTGGGTATGTATTTCTTGACCTTTGCTTCTGGTCGT<br>TTGTTTTGGGAGTTAGAAGAGAAGAATAGTTTGTGA<br>TTGTTACCTATTTATTTTTGCTCTTATGAAGCTCAAGC<br>TCAGCATTAGTTCTATTCCAGTTTAAAG |
| 45 | Amaranthus hybridus | cDNAContig | 1883 | CCCGTCGTTCCCGTCCGGTTCCGATCTGTAAACAATC<br>AAAACCGACGCTTCTGATAGCCAAGATCAATGCACT<br>GCAATCGGCTAGAACGGTTCCTCGACGTAGTCGTCT<br>CCTTCTAATAGATGACAGCCAAGAAAACGCCACAAA<br>ATCGTGTTCAAATGAAAAGATATACGGCTTAGATTC<br>AATGCTCAAATGTACAAGTCCAGGCTACACTCCATC<br>CTTCTTTCTCACTCCTTTATCTCTCTCTCTAGCTCAC<br>CCTTTTCCGAACCCAGGTAAAAGTGATCAAACATGG<br>CACAAATACTTGCACCTTACATGCAATGTCAGATGA<br>AGTTCTCAAAAGGCTCAACAAGTTCAATGACATCAA<br>ATCCTTGGACTTCAATATTTCTTAAAGAAAATAAAAA<br>GGGATCAATTAAATGCTCTAGTAAGTTTAGAGTATG<br>TGCTTCTCTCCAATCTGAAAATAGCACAATAAACAG<br>GGTGGAGCAGCTACTCAACTTGGATGTCACTCCATA<br>CACTGACAAGATAATTGCAGAGTACATTTGGATTGG<br>AGGATCTGGTATTGATGTTCGTAGCAAATCAAGGAC<br>AATCTCTAAACCTGTTGAGCACCCATCTGAGCTTCCC<br>AAGTGGAATTATGATGGCTCAAGCACTGGACAAGC<br>GCCAGGAGAGGACAGTGAAGTAATCTTATACCCTCA<br>AGCAATTTTCAAGGATCCGTTCCGTGGTGGTAATAA<br>TATCCTTGTAATCTGTGACACATACACACCAGCAGG<br>CGAACCCATCCCCACTAATAAAAGATACAGGGCTGC<br>ACAGATCTTTAGCGACCCAAAGGTTGTTTCTGAGAT<br>TCCATGGTTTGGAATAGAGCAGGAATACACGTTGCT<br>CCAACAAAACGTTAAATGGCCTTTGGGATGGCCTGT<br>TGGAGCCTATCCTGGTCCTCAGGGTCCATACTATTGT<br>GGTGCTGGTGCTGACAAATCTTTTGGACGTGACATA<br>TCTGATGCTCATTACAAAGCTTGCTTGTATGCTGGCA<br>TCAACATTAGTGGCACAAATGGGGAAGTTATGCCTG<br>GCCAGTGGGAATTCCAAGTTGCCCAAGTGTTGGTA<br>TTGAAGCTGGAGATCATATCTGGTGTGCAAGATATA<br>TTCTTGAGAGAATCACTGAACAAGCTGGTGTGGTTC<br>TGACTTTGGATCCAAAGCCTATTGAGGGTGATTGGA<br>ACGGTGCAGGTTGCCATACCAATTACAGTACAAAGA<br>CCATGAGAGAAGATGGTGGTTATGAAGCAATTAAG<br>AAGGCAATTTTGAATCTATCATTACGCCACAAGGAC<br>CATATCAGTGCATATGGAGAAGGAAATGAACGAAG<br>ATTGACAGGGAAGCACGAGACCGCCAGCATCGACA<br>CATTCTCTTGGGGTGTTGCCAATCGTGGTTGCTCTAT<br>CCGTGTGGGCCGTGACACAGAAAAAGCAGGCAAAG<br>GTTATCTGGAAGACAGGCGGCCTGCCTCAAACATGG<br>ACCCATACGTGGTGACAGGTTTGCTCGCAGAAACTA<br>CAATACTTTGGGAACCACACTTGAGGCTGAGGCAC<br>TAGCAGCCCAAAAACTCGCTCTTAATGTGTAATTCAA<br>TCATAATCGTGCCAGAATATCGCATATTCATGAACG |

TABLE 1-continued

Glutamine synthetase gene sequences isolated from various weed species

| SEQ ID NO | SPECIES | TYPE | LENGTH | SEQ |
|---|---|---|---|---|
| | | | | AGGGAACTCTTTCACGTGCCCAGAATTTGCTTATTTT TAGTTTTAGTATCCTGGGTATGTGAGTGTTTTCATT CATGACCTTTGCTTCTGATCATTGTTTGTTTTGGGAG TTCAAGAGAAGAATAATTTGTAACTGTTGCCTTCATT ATTTTTGCTACTCCGCCAATTGTAGTACATCATGAAA ATATGACTGCAACAGTTAAGCTACTCCGCCGATTCG GAAAATATAGATTGAAGGTGATATTTAAGTTTTCCTT |
| 46 | Amaranthus lividus | cDNAContig | 1683 | CCCATTTCATTCTGCTTACTCTCCATCCTTCTTTCTCAC TCCTTTATCTCTCTCTCTAGCTCACCCTTTTCCGAA CCCAGGTAAAAGTGATCAAACATGGCACAAATACTT GCACCTTACATGCAATGTCAGATGAAGTTCTCAAAA GGCTCAACAAGTTCAATGACATCAAATCCTTGGACT TCAATATTTCTTAAAGAAAATAAAAAGGGATCAATT AAATGCTCTAGTAAGTTCAGAGTATGTGCTTCTCTCC AATCTGAAAATAGCACAATAAACAGGGTGGAGCAG CTACTCAACTTGGATGTCACTCCATACACTGACAAGA TAATTGCAGAGTACATTTGGATTGGAGGATCTGGTA TTGATGTTCGTAGCAAATCAAGGACAATCTCTAAAC CTGTTGAGCACCCATCTGAGCTTCCCAAGTGGAATT ATGATGGCTCAAGCACTGGACAAGCGCCAGGAGAG GACAGTGAAGTAATCTTATACCCTCAAGCAATTTTCA AGGATCCGTTCCGTGGTGGTAATAATATCCTTGTAA TCTGTGACACATACACACCAGCAGGCGAACCCATCC CCACTAATAAAAGATACAGGGCTGCACAGATCTTTA GCGACCCAAAGGTTGTTTCTGAGATTCCATGGTTTG GAATAGAGCAGGAATACACGTTGCTCCAACAAAAT GTTAAATGGCCTTTGGGATGGCCTGTTGGAGCCTAT CCTGGTCCTCAGGGTCCATACTATTGTGGTGCTGGT GCTGACAAATCTTTTGGACGTGACATATCTGATGCTC ATTACAAAGCTTGCTTGTATGCTGGCATCAACATTAG TGGCACAAATGGGGAAGTTATGCCTGGCCAGTGGG AATTCCAAGTTGGCCCAAGTGTTGGTATTGAAGCTG GAGATCATATCTGGTGTGCAAGATATATTCTTGAGA GAATTACTGAACAAGCTGGTGTGGTTCTGACTCTTG ATCCAAAGCCTATTGAGGGTGATTGGAACGGTGCA GGTTGCCATACCAATTACAGTACAAAGACCATGAGA GAAGATGGTGGTTATGAAGCAATTAAGAAGGCAAT TTTGAATCTATCATTACGCCACAAGGACCATATCAGT GCATATGGAGAAGGAAATGAACGAAGATTGACAGG GAAGCACGAGACCGCCAGCATCGACACTTTCTCTTG GGGTGTTGCCAATCGTGGTTGCTCTATCCGTGTGGG CCGTGACACAGAAAAAGCAGGCAAAGGTTATCTGG AAGACAGGCGGCCTGCCTCAAACATGGACCCATAC GTGGTGACAGGTTTGCTCGCAGAAACTACAATACTT TGGGAACCAACACTTGAGGCTGAGGCACTAGCAGC CCAAAAACTCGCTCTTAATGTGTAATTCAACCATAAT CGTGCCAGAATATCGCATATTCATGAACGAGGGAAC TCTTTCACGTGCCCAGAATTTGCTTATTTTAGTTTTAG TATCCTGGGTATGTGAGTGTTTTCATTCATGACCTTT GCTTCTGATCATTGTTTGTTTTGGGAGTTCAAGAGA AGAATAATTTGTAACTGTTGCCTTCATTATTTTTGCT ACTCCGCCAATTGTAGAACACCATGAAAATATGACT GCAACAGTTAAGCTACTCCGCCGATTCGGAAAATAT AGATTGAAGGTGATATTTAAG |
| 47 | Amaranthus spinosus | cDNAContig | 1743 | CCATTATTCCACACTCCACACTACCCATTTCATTCTGC TCACTCTCCATCCTTCTTTCTCGCTCCTTTATCTCTCTA TATTCATCTCTCTCTAGCTTGTTCACGACGCCGAC CACCCTTTTCCGATCCCAGGTAAAAGTGACCAAACA TGGCACAAATACTTGCACCTTACATGCAATGTCAGA TGAAGTTTTCAAAAGGCTCCACAAGTTCAATGACAT CAAATCCTTGGACTTCAATATTTCTTAAAGAAAATAA AAAGGGATCAATTAAATGCTCTAGTAAGTTCAGAGT ATGTGCTTCTCTCCAATCTGATAATAGCACAGTAAAC AGGGTGGAGCAGCTACTCAACTTGGATGTCACTCCA TACACTGACAAGATAATTGCAGAGTACATTTGGATT GGAGGATCTGGCATTGATGTTCGTAGCAAATCAAG GACAATCTCTAAACCTGTTGAGCACCCATCTGAGCTT CCCAAGTGGAATTATGATGGCTCAAGCACTGGACAA GCGCCAGGAGAGGACAGTGAAGTAATCTTATACCCT CAAGCAATTTTCAAGGATCCATTCCGTGGTGGTAAT AATATCCTTGTAATCTGTGACACATACACACCAGCA GGCGAACCCATCCCCACTAATAAAAGATACAGGGCT |

TABLE 1-continued

Glutamine synthetase gene sequences isolated from various weed species

| SEQ ID NO | SPECIES | TYPE | LENGTH | SEQ |
|---|---|---|---|---|
| | | | | GCACAGATATTTAGCGACCCAAAGGTTGTTTCTGAG<br>ATTCCATGGTTTGGAATAGAGCAGGAATACACGTTG<br>CTCCAACAAAATGTTAAATGGCCTTTGGGATGGCCT<br>GTGGGAGCCTATCCTGGTCCTCAGGGTCCATACTAT<br>TGTGGTGCTGGTGCTGACAAATCTTTTGGACGTGAC<br>ATATCTGATGCTCATTACAAAGCTTGCTTGTATGCTG<br>GCATCAACATTAGTGGCACAAATGGGGAAGTTATGC<br>CTGGCCAGTGGGAATTCCAAGTTGGCCCAAGTGTTG<br>GTATTGAAGCTGGAGATCATATCTGGTGTGCGAGAT<br>ATATTCTTGAGAGAATTACTGAACAAGCTGGTGTGG<br>TTCTGACTCTTGATCCAAAGCCTATTGAGGGTGATT<br>GGAACGGTGCAGGTTGCCATACCAATTACAGTACAA<br>AGACCATGAGAGAAGATGGTGGTTATGAAGCAATT<br>AAGAAGGCAATTTTGAATCTTTCATTACGCCACAAG<br>GACCATATCAGTGCATATGGAGAAGGAAATGAACG<br>AAGGCTGACAGGGAAGCACGAGACCGCCAGCATCG<br>ACACATTCTCTTGGGGTGTTGCCAATCGTGGTTGCTC<br>TATCCGTGTGGGTCGTGACACGGAAAAGGCAGGAA<br>AAGGTTATCTGGAAGATAGACGGCCTGCCTCAAACA<br>TGGACCCATACGTGGTAACAGGTTTGCTCGCAGAAA<br>CTACAATACTTTGGGAACCAACACTTGAGGCTGAGG<br>CACTCGCAGCCCAAAAACTCGCTCTTAATGTCTAATT<br>CAATCATAATTCGTGCCAGAATATCGCATATTCTTGA<br>ACGAGGGAACTCTTTCACGTGCCCAGAATTCGCTTTT<br>TTTAGTTTTAGTATCCTGGGTATGTGAGTGTTTTCAT<br>TCGTGACCTTTGCTTCTGATCATTGTTTGTTTTGGGT<br>GTTCAAGAGAAGAATAATTTGTAACTGTTGCCTTCTT<br>TATTTTTGCTCTTATGAAGCTCAAGCTCGGTATTTTA<br>GTTATATTCCAGTTTAAGGAATGAACTTCAAAATCCT<br>TGTTACTCATCTTCAACTCCATTGAATATATACGCT |
| 48 | Amaranthus thunbergii | cDNAContig | 1702 | CATTATTCCACACTCCACACTACCCATTTCATTCTGCT<br>TACTCTCCATCCTTCTTTCTCACTCCTTTATCTCTCTCT<br>CTCTCTAGCTCACCCTTTTCCGAACCCAGGTAAAAGT<br>GATCAAACATGGCACAAATACTTGCACCTTACATGC<br>AATGTCAGATGAAGTTCTCAAAAGGCTCAACAAGTT<br>CAATGACATCAAATCCTTGGACTTCAATATTTCTTAA<br>AGAAAATAAAAAGGGATCAATTAAATGCTCTAGTAA<br>GTTCAGAGTATGTGCTTCTCTCCAATCTGAAAATAGC<br>ACAATAAACAGGGTGGAGCAGCTACTCAACTTAGAT<br>GTCACTCCATACACTGACAAGATAATTGCAGAGTAC<br>ATTTGGATTGGAGGATCTGGTATTGATGTTCGTAGC<br>AAATCAAGGACAATCTCTAAACCTGTTGAGCACCCA<br>TCTGAGCTTCCCAAGTGGAATTATGATGGCTCAAGC<br>ACTGGACAAGCGCCAGGAGAGGACAGTGAAGTAAT<br>CTTATACCCTCAAGCAATTTTCAAGGATCCGTTCCGT<br>GGTGGTAATAATATCCTTGTAATCTGTGACACATAC<br>ACACCAGCAGGCGAACCCATCCCCACTAATAAAAGA<br>TACAGGGCTGCACAGATCTTTAGCGACCCAAAGGTT<br>GTTTCTGAGATTCCATGGTTTGGAATAGAGCAGGAA<br>TACACGTTGCTCCAACAAAATGTTAAATGGCCTTTG<br>GGATGGCCTGTTGGAGCCTATCCTGGTCCTCAGGGT<br>CCATACTATTGTGGTGCTGGTGCTGACAAATCTTTTG<br>GACGTGACATATCTGATGCTCATTACAAAGCTTGCTT<br>GTATGCTGGCATCAACATTAGTGGCACAAATGGGG<br>AAGTTATGCCTGGCCAGTGGGAATTCCAAGTTGGCC<br>CAAGTGTTGGTATTGAAGCTGGAGATCATATCTGGT<br>GTGCAAGATATATTCTTGAGAGAATTACTGAACAAG<br>CTGGTGTGGTTCTGACTCTTGATCCAAAGCCTATTGA<br>GGGTGATTGGAACGGTGCAGGTTGCCATACCAATTA<br>CAGTACAAAGACCATGAGAGAAGATGGTGGTTATG<br>AAGCAATTAAGAAGGCAATTTTGAATCTATCATTAC<br>GCCACAAGGACCATATCAGTGCATATGGAGAAGGA<br>AATGAACGAAGATTGACAGGGAAGCACGAGACCGC<br>CAGCATCGACACTTTCTCTTGGGGTGTTGCCAATCGT<br>GGTTGCTCTATCCGTGTGGGCCGTGACACAGAAAAA<br>GCAGGCAAAGGTTATCTGGAAGACAGGCGGCCTGC<br>CTCAAACATGGACCCATACGTGGTAACAGGTTTGCT<br>TGCAGAAACTACAATACTTTGGGAACCAACACTTGA<br>GGCTGAGGCACTAGCAGCCCAAAAACTCGCTCTTAA<br>TGTGTAATTCAATCATAATCGTGCCAGAATATCGCAT<br>ATTCATGAACGAGGGAACTCTTTCACGTGCCCAGAA<br>TTTGCTTATTTTAGTTTTAGTATCCTGGGTATGTGA<br>GTGTTTTCATTCATGACCTTTGCTTCTGATCATTGTTT |

TABLE 1-continued

Glutamine synthetase gene sequences isolated from various weed species

| SEQ ID NO | SPECIES | TYPE | LENGTH | SEQ |
|---|---|---|---|---|
| | | | | GTTTTGGGAGTTCAAGAGAAGAATAATTTGTAACTG TTGCCTTCATTATTTTTGCTACTCCACCAATTGTAGAA CACCATGAAAATATGACTGCAACAGTTAAGCTACTC CGCCGATTCGGAAAATATAGATTGAAGTGATA |
| 49 | Amaranthus viridis | cDNAContig | 1744 | CCATTATTCCATTCTACCCATACTTGGGACAATCATA CTCCTCTAACTCCTTTAACCATACTCATTACACACTCT CTCTTCTTTATCTCTCTATATTCTTCACTCTCTCTCTAG TTACTTGACGCCGCCGACCACCTTTTCCGAACCCAGT GACCAATTATGGCACAGATACTTGCACCTAACATGC AATGTCAGATGAAGTTTTCCAAAGGCTCGACAAGTT CAATGACATTAAGTCCTTGGACTTCCATATTTCTGAA AGAAAACCAAAAGAAATCGATTAAATGCTCTAGTAA GTTCAGAGTGTGTGCTTCTCTCAAATCTGAAAACAG CACTGTAAACAGGGTGGAGCAGCTACTCAACTTGGA TGTCACTCCATACACTGACAAGATAATTGCAGAGTA CATTTGGATTGGAGGATCCGGTATTGATGTCCGTAG CAAATCAAGGACAATCTCTAAACCTGTTGAGCACCC ATCTGAGCTTCCCAAGTGGAATTATGATGGCTCAAG TACAGGACAAGCTCCCGGAGAGGACAGTGAAGTAA TCTTATACCCTCAAGCAATTTTCAAGGATCCATTCCG TGGTGGTAATAATATCCTTGTAATCTGTGACACATAC ACCCCAGCAGGCGAACCTATTCCCACTAACAAAGA TACAGGGCTGCACAGATATTCAGCGACCCAAAGGTT GTTTCCGAGGTTCCATGGTTTGGAATAGAGCAGGAA TACACTTTGCTCCAACAAAATGTTAAATGGCCTTTGG GATGGCCCGTGGGAGCCTATCCTGGTCCTCAGGGTC CATACTACTGTGGTGCTGGTGCTGACAAATCTTTTG GACGTGACATATCTGATGCTCATTACAAAGCTTGTTT GTATGCCGGTATTAACATTAGTGGCACAAATGGGGA AGTTATGCCTGGCCAGTGGGAATTCCAAGTTGGTCC AAGTGTTGGCATTGAAGCTGGAGATCATATCTGGTG TGCTAGATACATTCTCGAGAGAATTACTGAACAAGC TGGTGTGGTTCTGACTCTTGATCCAAAGCCTATTGA GGGTGATTGGAATGGTGCAGGTTGCCATACAAACT ACAGTACAAAGACCATGAGAGAAGATGGTGGTTAT GAAGCAATTAAGAAGGCAATTTTGAATCTATCATTA CGCCACAAGGACCATATCAGTGCATATGGAGAAGG AAATGAACGAAGATTGACAGGGAAGCACGAGACCG CCAGCATCGACACTTTCTCTTGGGGTGTTGCCAATC GTGGTTGCTCTATCCGTGTGGGCCGTGACACAGAAA AAGCAGGCAAAGGTTATCTGGAAGACAGGCGGCCT GCCTCAAACATGGACCCATACGTGGTGACAGGTTTG CTCGCAGAAACTACAATACTTTGGGAACCAACACTT GAGGCTGAGGCACTAGCAGCCCAAAAACTCGCTCTT AATGTGTAATTCAACCATAATCGTGCCAGAATATCG CATATTCATGAACGAGGGAACTCTTTCACGTGCCCA GAATTTGCTTATTTTAGTTTTAGTATCCTGGGTATGT GAGTGTTTTCATTCATGACCTTTGCTTCTGATCATTG TTTGTTTTGGGAGTTCAAGAGAAGAATAATTTGTAA CTGTTGCCTTCATTATTTTTGCTACTCCGCCAATTGTA GAACACCATGAAAATATGACTGCAACAGTTAAGCTA CTCCGCCGATTCGGAAAATATAGATTGAAGGTGATA TTTAAG |
| 50 | Euphorbia heterophylla | gDNAContig | 4893 | AAGTCACTGCTATTCTGTGCTAAACTAGATTTATACT TATTTACAACTGATGACTGCTGATTTAGTGATTTAGT GATTTAGATCGTACTTTCTTTGTTTTGCTCGATTTTCG GACGTCGATTCGATATATACAGATTTGATGAACAGC ATTGTTGCCAATGATCAGTAGTAGTAATGTTGTTGA AAGCTTTCAGTTATAGTGATATCTTCCATCTGCTAGT TTTTTTAGAGAAAATCAGTTTTTGCTAGGAGGAAAA AGGGAATTACTAAAAAAATTATAAATGTTCTTTCAA AATTTGAGCGAAGAAATAATGGTTATTAAACACTA ATTTTGAGCTGAAAGAATATGATCAGATGCTTTTGT ATTCTAATGTCTTGAATCCTAATATGCACCTTTAAAA CCTTTTGTTTTTCAATGAAAAAGTAAGGAAAAAGAT TATTTGCATTAGTGGCACGAGTCTAATCTAATAACCG TGGTTTCGTCTCTTCTCTTTCAAAAATTGGAAAAGTG TTGATGTCATTTTCTAACATTTCCTACTAAGTACTAAC CAAAACAAGGTTTCTTTCCACTAATAGAATTTTCCT TTACCACATTTATACAGTATAAAAATCTCTAACTTTA GACTTTAGAGCATACTATCACATCATGGTGTTGTCAT AGTATATTCATATTAGAGCAGGTTTAGCCCCAAGTCT |

TABLE 1-continued

Glutamine synthetase gene sequences isolated from various weed species

| SEQ ID NO | SPECIES | TYPE | LENGTH | SEQ |
|---|---|---|---|---|

GAAGACTTGGGATGAAATTACCTTTATTGTCTTAAG
ATTTAGATTTAAGATTTTCCCATTTTTCTTTTAAAATC
TTAGCCAGATCTCAAGTTGATTTCAAGGCTCAACTTA
AGACTTGAAACACGGGACCCACCCTAATTTAATAAT
GTTTGTTTTCATATAGATAACATAAAGAGATAAAAA
AAAGTAAAATATCATGGTATATATTTAAGACTAGGA
GTCTTAGGGCTAAAGTGATAAAGTTGGACAAGTTTT
ATGGAGTTTAAGAATAATTGATAACATTATTTTTGTG
GGAACCACTAAAAAATGATGTTACACCCAAGTTTTA
AGACTTGGTGCTAAGCTTGCTGTTACAAATTGGTTTC
AATCATAACAGTTATTCCTTATCTTTGACTAGGAATT
TAGTCCAAATCTTTTGTTGTGGTGTACTGGTGTCGA
GGATACAACATGGATACCTAACGGGAAGAAAAGAG
TTTTTGCAACTTATATTGTCTGTCTGTGTTTAATGTTG
CCACTTCTACGGGAATTCTGGTTTCTGTAATCCAGGA
TTAAAGAGCTGTCAGCTGTTGTACTGTAAATTGTTTG
TGTAATAGTTTTAATTTTTGTAGGGAAAGGACCAAA
TATGGCCCAGATTCTCGCTCCTAGCATGCAATGTCA
GTTGAAATTCTCAAAAAGCTCATTAAGCTCGCTAGC
ATCGAACACGTGGACCTCCATTTTGCTAAAAGGAAA
CCAAAAGAGATCGCTTCATTGCTCAACTAAGTTCAA
GGTATCCGCTGCTCTCAAATCTGATGATGGTACTATC
AACAGGGTAGAGCAGCTACTCAATTTGGATGTCACT
CCATACACTGACAAGATTATTGCTGAATACATATGG
TATAGTTTCCCATTCTGATTTTGGCATCTTTATCGAG
GGTTATTTTTCTCAAATATGCTTGATGAGGTTATGG
TAGAATCAACATATTAGGGCTTTACTTGCATGGTTGT
ATTAGGCTCTTTTGTTGTAGAAAAGCCTGCTTGGTA
ATTCAGTGTCCAGGTGTTGATGGAACTAATTGAATT
ATGATTGTTCATTGGAATAGGATTGGAGGATCTGGG
ATTGATGTTCGCAGTAAATCCAGGGTATAGTAACAT
CCATTCTGTAGCTTGATTGTTAACCACCTATTAGATG
CTGACTAATGTTTTCTTAATAATACCAGACAATCTCA
AGACCTATTGAGGATCCATCTGAACTTCCCAAATGG
AACTTTGATGGGTCAAGCACTGGACAAGCGCCGGG
AGAAGACAGTGAAGTAATCTTATAGTAAGATCCTCT
TACATCTATGAATCTTCATCATTTTCCCCATAAATTCA
TTATTCATTATTTCCGAGTCTTTCTTTTATTCTTGTCTT
TTAATGACTGATCATTAGTCATTGTTGTCTTGCATTT
CTTCTGCAATAGCCCTCAAGCAATTTTTAAGGATCCT
TTTCGTGGTGGTAACAATATCTTGGTGAGTTTGATA
GAGCATATGAATCGGTTATTCTAAAGTTATAGTATTT
CTTATAAATAATAAATTTATTTGTTAAGGTTGCAACC
ATAATTTATGATTTGTAAATCTAGGTGATCTGTGATG
CATACACACCAGCAGGTGAACCCATCCCAACTAATA
AACGACACAAAGCTGCACAGATCTTCAGCAACCAAA
AGGTTGTTTCTGAGGTTCCATGGTATGAAGTTCCTT
GTACTGATAAAATCCATTTATGAATTGTTAATAACCA
CTTTGCATTTGAACATTAAATTTTGTGTACAAAGTTT
CCTATTATAGGAAGGATAATTAATTAATCATAATTG
GGAGGGTGAAATTGAGAAGAAAAAAGAGGATTGC
ATGAACAGTCCAATGCATTTTGTTGCTGACATGAGA
GCAATTTGGGGCTTTGTAGAGCTGGCTGGATTGTGG
AATGTAATCAACAGGAAACTGATGACTGACCACTGT
GAATATGATCTGTTATGACACATTTCATTTTTCGAAT
AGAGGAATTTCATTGCCAGGTTGACCTATAACAGTA
TAACTATGTCAGAACAGAGCTTCTCGATTTCAAAATT
GTGTTGGCTTTTTTCTTTTTCAAATAATCAGAAGAGA
CTCATCTTTAGTTTTCTGTGTTATCGTTCTACTTTAAG
CTTTTATTACTCTTTGTTTTAGTCATTTAATCATATTTT
TACAGGTTTGGAATAGAGCAGGAATACACGCTTCTT
CAACCAAATGTTAATTGGCCCTTGGGATGGCCTGTG
GGAGCTTATCCCGGTCCTCAAGTATGTTACTCAGTT
GCTCCTATTTCATATTCATTTTGTCCAATGAAGATGC
TTTGTTGTGTTATAGATTAGAATCGTTTTGTTACGCA
AAATGATTTTTTTCGCATTTTCTAGGGTCCATATTATT
GTGGTGTTGGTCTGAAAAATCTTTTGGACGTGACA
TTTCTGATGCTCACTATAAAGCTTGCCTGTATGCTGG
AATTAACATCAGTGGCACCAATGGGAAGTTATGCC
TGGCCAGGTATTCACTTACATCATTCTAGTATGTCTA
CCAGTCATAAATTTGCTTTGAATCTTGTAACTCAATA
GCTGTATATCCACTTGTACCTACAGTGGGAATTCCA
GGTTGGTCCTAGTGTTGGGATTGAAGCAGGAGATC
ATATCTGGTGTGCCAGATATATTCTTGAGGTATTCTC

TABLE 1-continued

Glutamine synthetase gene sequences isolated from various weed species

| SEQ ID NO | SPECIES | TYPE | LENGTH | SEQ |
|---|---|---|---|---|
| | | | | CTGCAATTTGTATGTTTCCCTCTGCGCTTATCAGTTA CAACTATAGTTTTGTAATTTGCTGCCCTATCGTTTTAT TATTCATTATTTTTCTACTTGAATTCTGCTTGAAAGAA AATAAGCTACTTTGACACAGACTCGAAGTGAAAGTG ACCATATGAGAATCAAACTGACCTTGGAATTATATG TGATTAACAACCGAATCTAATCTCTTATGGAAGACAT AAATTAATAATACTTAATAGGCTCCAATGTGGATGA CCTCCCGGAATAATCACTTTTGGTTCATGTTAGCCGA CCCCTCATATGTGATTAAGGCTTTGATTGATTGATTG AATAGGCTCCAATGTGACCCAAACTCACCAAGGGTA AATAAATGCTATTTTACCTGTATTGTATGGCTAACTA TGGCTAACCAGATATAACCATAACTGAATTGTTAAA CTGAATAATTTAAGAATCATAAGTAGCTTTATAATGT AGGGACATTGGGGTGACTCATGACGAGGGAGTGAG GCACAAATGAAATAGGTCTAAAATGAACTATTGATG AATATTTAAGTTTGCAATTGAAGATCCACATTATCAT CTAATTGTAAAACATAATTGCTAATGCTCAACAGAA CCTAGTCCTTTAAGTAGAAGCCAAATTCATTAGAAG TTTAGCACATTGTGAAACCTTGATCCATATCAATATA TGTAGGCTGAAGAAATTACAGCTCAAATTTTGTTATT AGTTGTAGCTTTAGTGTTGAGTTAAGTATAAACTATA AAGATGGGCACTCAACTTTAGACAAAATCGCAATTT GAGCACTCAACTTTAGACAAAATTGCAATTTGAGCA CTCAACTTTGAAAAGTTGCAAGTTGATTACTAATTTT GGTTAACTATAGTTCTACCCTCCTCCATCCTTAAATCT CTTGCTACTAGTCCAGCACCACAATCAAAATCCTAGC AGTCATGCTACCAATTTGCCACTGACCATTCAATCCA CTAGAGAACCCCCCAAAAAGCACCATGCACCAGTGC ACCACCACCCAAAAAAATCACGGGTCACCACGATGG AACCAACTATTAAGAAAAAACCCACCATTACCACCAT TAAATTTGAACCAACTATTAAAGAATTGCTTAATTTG TACACAATGATCATAAAAAAAAAGTTTGCACCCCAT TCAATAGAAGTGAAGAATGTTATACGGAGTACAATG AATCAAACATAAAATTCAGCCAATTGACAATTACAA TTTCTTCAAAGCTGCCATAAATGAAAAACCATACTCA CTATCAAATTTGAAAGAAAACCATCAAATTCAAACC CATAATTAGAAGTAAAAGTGTTGGGTAAAGCGGGT TTCCGTTAACATTAATGAAAACGATCTAATATACTGT AATTTTGATAGTATTTTTTTGTGTAACTTTAACATTTT TATTGTAACCTGGATGGTTGAGGGTTGAAGATTTGG AATGTCGAATTAACTTGGATGAACAATGG |
| 51 | Sorghum halepense | cDNAContig | 1581 | CCACAAGTGTGGTACGGCCATTATTGGAGGATTACA CAAGAAGAAGAAGGTAGGAGGAGATCACCCAAGC GGACGGACGGCATGGAATGGAAGTGGGAAGCGTC AAAGTTTTTATGTGTTTTGTTTTGGCACACCACGACC TGACCCAAATTCTAGCTAAATTGCAGTAGTAGAGTA GTATAAGCAAACGGAACGGGAAGGAACAATTGTTG CGCAAATCGCTGGACGGGACCCTGCAATGCAACGG CCGGACACTGCCGCGGAACAAACCGACACGACAAA CGGCGAGCTGGATGGAGGAAACCTTCCGCTTCAGG GCTTCCAGAGGATGGTGGTGTCGGCGATCATGGAG GTCACCACGTATGGGTCCATGTTGGACGCCGGCCGG CGGTCCTCGAAGTAGCCCTTGCCGTTCTGCTCCGTCT CCCGGCCCACGCGCACTGACGCGCCACGGTTTGCCA CTCCCCAGCTGAAGGTGTTGATGTCGGCGGTCTCGT GCCTGCCGGTGAGGCGGCGCTCGTTGCCCTCGCCGT AGGCCGCGATGTGCTCCTTGTGCCGCAGCTTCAGCT TCTCGATGGCGGCCTTGATCACCTCGTACCCGCCCTC GTTCCTCATGGACTTGGTGCTGTAGTTGGTGTGTGC GCCGGCACCGTTCCAGTCACCAGGGATGGGCTTTGG GTCGAATGTCAACACCACACCGGCGATCTCGGTGAT CCTCTCAAGAATGTAGCGAGCAACCCAGACCTGATC GCCTGAAGAAATGCCGACGGACGGTCCAACTTGGA ATTCCCACTGCCCTGGCATGACCTCTCCGTTGATGCC ACTGATGTTGATGCCTGCATAAATGCAAGCCTTGTA GTGGGCATCAACTATATCACGCCCGAATGACTTGTC CGCACCAACTCCACAGTAGTACGGACCCTGAGGGCC AGGGAAGCCACCAAGAGGCCACCCAAGGGGCCAGT TGGTGTCCTTCTGAAGGAGGGTGTACTCCTGCTCAA TACCGTACCAGGGCTCCTCAGCGGCGACCTCAGGGT TGCTGAAGATCTTGGCGGCGTTGTGCCTCTTGTTGG TGGGAATTGGCTCGCCAGCTGGGGTGTAGCAATCG CACATGACAAGGATGTTGTTGCCCCTCCGGAATGGG |

TABLE 1-continued

Glutamine synthetase gene sequences isolated from various weed species

| SEQ ID NO | SPECIES | TYPE | LENGTH | SEQ |
|---|---|---|---|---|
| | | | | TCCTTGAAGATAGCCTGCGGGTACAGGATGACCTCA CTGTCCTCGCCGGGGGCCTGGCCGGTGCTGGAGCC GTCGTAGTTCCACTTGGGCAGCTTGCTGGGATCGGT CACCGGGCCGGAGAGGGTCCTGGCTTTGCTCCTGA GATCCATGCCAGATCCACCGATCCATATGTACTCGG CGATGATCTTCTCGGTGGTGTCCGAGAGGCTGAGGT TGACGAGGTCGGTGAGGGAGGCCATGGCCGGCGG CGGCTGGGAAGGACCCAAAGGAGGAAGAAGAGGG AGGAGGTGGTGGTAGCGATCAAGAACTTCTCTGGTT TTGTTGAGGCTGACAAGGATGGAAATTGGTCTTGTC CAACTGACAAGAAGCGTAAGCAAGAGATATTTCCG AACCCTGTATTAGAAGTTAACAGACTAGTTGCTAGT CTTCAATCGTAC |
| 52 | Convulvulus arvensis | cDNAContig | 710 | AAGAATATACTCTCCTTCAAAAAGATGTTAATTGGCC ACTTGGGTGGCCTGCTGGAGGTTATCCTGGTCCACA GGGACCATACTACTGTGGAATTGGAGCCGATAAGG CTTTTGGGCGTGACATTGTCGACTCGCACTATAAGG CCTGCCTTTACGCGGGGATTAACATCAGCGGTATCA ATGGCGAAGTGATGCCTGGACAGTGGGAATTCCAA GTTGGACCGGCTGTTGGCATCTCAGCTGGCGATGA GGTGTGGGTAGCTCGCTATATTCTCGAGAGGATTTC TGAGATTGCTGGAGTTGTTGTCTCATTCGACCCCAA ACCTATCCCGGGTGATTGGAATGGTGCTGGAGCTCA CACAAACTACAGCACTAAGTCAATGAGGAATGAGG GTGGATTTGAAGTCATCAAGAAGGCAATTGCAAAG CTTCAGGTGAGGCACAAGGAGCACATTGCTGCATAT GGTGAGGGCAACGAGCGCCGCTTGACCGGAAAACA CGAGACAGCTGACATCAACACCTTCTCATGGGGAGT TGCGAATAGGGGTGCATCGGTTCGTGTGGGCCGGG ACACGGAGAAAGATGGCAAGGGTTACTTTGAGGAC CGAAGGCCGGCTTCGAACATGGATCCCTACACTGTG ACCTCCATGATTGCAGAGACCACCATCCTGAACAAA GATTGAGCTGTTTCTTGGTGGGATGTGTTTGGA |
| 53 | Chenopodium album | cDNAContig | 1276 | TCATATTCTGAAAGTCTCATAAAAAGAGAAAGATCT CTTTATTATTTTCCAATCAATCAACCAAATTGTTTCAT CCAAATCCCAAAAAAAATATGTCGCTTCTTTCAGATC TTGTTAACATTAATCTCTCAGACTCCACTGATAAGGT CATTGCTGAGTACATATGGATTGGTGGATCTGGTAT GGACATGAGAAGTAAAGCAAGAACACTCAATGGAC CAGTTTCTGATCCAAAAGAGTTGCCAAAATGGAATT ATGATGGATCTAGCACTGGTCAAGCTCCTGGTGAAG ACAGTGAAGTCATTCTCTACCCACAAGCTATCTTCAA AGATCCATTCAGGAGGGGCAACAATATTCTTGTCAT GTGCGACGCATATACCCCTCAAGGAGAACCAATCCC CACCAACAAGAGACACGATGCTGCAAAGATATTCAG CCATCCAGGTGTAGCTGCTGAGTGCCTTGGTATGGT ATCGAGCAGGAGTACACCTTGCTGCAAAAGGACGTT AATTGGCCCATTGGCTGGCCTGTCGGAGGTTTTCCT GGTCCACAGGGCCCCTACTACTGTGGTATTGGTGCT GATAAAGCTTTTGGAAGGGACATTGTTGATTCACAC TACAAGGCTTGCCTTTATGCAGGAATTAACATTAGT GGAATCAATGGAGAAGTGATGCCAGGACAGTGGGA ATTCCAAGTCGGTCCATCAGTTGGAATCTCTGCTGG AGATGAGTTATGGGTAGCTCGTTACATTTTGGAGAG GATTACTGAGATTGCTGGAGTGGCTCTTTCTTTTGAT CCAAAGCCAATTCCAGGTGATTGGAACGGTGCTGGT GCTCACACAAACTACAGCACAAAGTCCATGAGGGA AGATGGTGGCTATGAAATCATTAAACAAGCTATTGA AAAGCTTGGATTAAGGCACAAGGAACACATTGCTGC TTATGGTGAAGGAAATGAACGCCGTCTCACTGGTAA ACACGAAACAGCCAGCATTTCAACCTTCTTGTGGGG AGTAGCCAACCGAGGTGCATCAGTTCGTGTTGGACG AGACACTGAAAGGAGGGAAAAGGATATTTCGAGG ACAGGAGGCCGGCTTCTAACATGGACCCTTACGTTG TCACTTCCATGATTGCAGAAACCACTATTCTTTGGAA ACCATAGAGTCCAAGCTTCAATCTTTAACCACCCTTT CTATATTAAGTCATTTGCTTTAAATCAGCAGCTGTCT ACTCAAGCTGTTAGGATTTTTCGATTTTCTATACATA ATGGCCATTG |
| 54 | Ambrosia artemisiifolia | gDNAContig | 671 | TTTAACAATTTAATACATTTTTGTTGTGAAAAGATTT GATCTTTATGTTTTATTTGTTGCAGGGCGTTGCAAAC |

TABLE 1-continued

Glutamine synthetase gene sequences isolated from various weed species

| SEQ ID NO | SPECIES | TYPE | LENGTH | SEQ |
|---|---|---|---|---|
| | | | | CGTGGAGCATCTATTCGGGTCGGGAGGGACACTGA GAAAGAGGGGAAAGGGTACTTTGAGGACCGAAGG CCGGCTTCTAACATGGATCCATATGTGGTGACCTCC ATGATTGCTGAGACCACCATCTTGTGGAACAAATCT TGAAGATAACAAGATTTGGATGATGACATTATGAAG CCTGATATGGAGGGAGATTGAAAAAAGTAACTGGA AATTTGGAAACAACCCTTCTATATGTACTTTGTTAAAA TTTAGGTGCATCCTACTCTGTTTGCTTGTTTATTTTA CTTGATGTTTCATATGTTCTTTATAATGGAAAGCATT TTGAGTCCAAAATGCTAATGGTAGCTACTTGATTTG ATTTGAGATTTTCCCATTGGGAATATTGTCAATATGT CTATTTTGAATAACAATATGGAGGGGTTGATTCCTAT TTGTGTTTGTGTTTTTGTTTGCTTGACATGCATTCATT ATACTCATTAAGTACATAAAATTTAAGAAAATTTTCT AAAAGCATCATTCAATCATATTCTTTATCCTTATACCC TATTCATATATTTATTTGAAAACTAAAGTGAGTTCTT ATATTAAAGAAAT |
| 55 | Euphorbia heterophylla | gDNAContig | 3047 | AACAATTAATCAATCATATTTGCGTAACTTTTTAATA AGGAATGTAGGTATAGATTTCGAGAAAATCCAAAG CTCGATATAAGTTTTAATTGTCACTCACCACCCACCT TTTTTTTGAAAATATATAAATTAAAACATAAACGGAA TTATCGGTTAATGAAATATAATTGTATATACTAACCG AAAAAATAATTGTGAGATGAGTAAATAACTTATATT GTGTTATTTGATTTTTGCACTTTGTGTATGAATTTGC GGGTAATAACAATTTATTTAATCAAATACTATCGTTT ATTTTATGATAAAAAATATACAGATATTTTTAATTTT GTTTATTTTGTCTAAATTATTTATTTTGTCTAAATTAA TACCACAGATCATTTAATTGGCCTCGCTAAATTATGA ATAAATAATGATGACCAAGTGTCCAAGTACACAAGC TTGTTTTCATCATAGTTGTTGGCTTGTTCCAACTTGC AATTGTCGCTTAGCTTATCCCACTACACAACAATTGA AGGCTAAAATGCTCATTAGCTTATGTCATGCACCA AATATGGGGTCATGTGCACCATATGATGCACTCTAT GCAAACATACCCTATTCATTTAGTGCGCGTTTTTTTT CACCTTATTAAACCCGAACTTAAATTCAAACTAAACT TAATGTTTATTACCCCAATGTTTCAGGTATGGCATTG AGCAAGAATACACACTCCTTCAGAAGGAGGTCAACT GGCCTCTTGGTTGGCCAGTTGGTGGCTTCCCTGGTC CTCAGGTGCGCTATCAAAACCAAACTTTCTTCATTTG TTACTCTTTTCGTATACATTTATTTTCTTATACTTTCGC GCTGTTTTGCAACTGATCTAAAACTTTTTGTGTGATT GTCTTTGGCGGGTGCAGGGTCCATACTACTGTGGTG TAGGGGCTGATAAATCGTTTGGCCGTGACATTGTGG ATGCTCACTACAAGGCTTGCCTGTATGCCGGTATCA ATATCAGTGGAATCAACGGTGAAGTCATGCCAGGA CAGGTATGAAACTATGAATGCATAGTGTCTATTCAG TTGGTTTCGACAGCTGATCCATAACACAACAATAGTT TCACACTAATAGTGGATTCGATGATCTGATCAACATT GCTTGCTTGATCTTTTTTCGTGCAGTGGGAATTCCAA GTCGGACCTACTGTTGGAATTTCTTCTGGTGATCAA GTCTGGGTTGCCAGATACATCCTAGAGGTAATCTGT TAGTCCTTTTCTGCTCTACTTATTGTTCGTGTTTCTCG CGTCTTGCATTCTTTGGCTATCTCGGTGTCTGACCCA ATGCTCGCTCTCATCTACAGAGGATTGCAGAGATTG CTGGAGTAGTTGTTACTTTCGACCCTAAACCAGTGA AGGTCTGCCTAATATACCAATCTTTTTTTCTGTGAAA ATTTATGCAAGAGAATATCAGTTATCATGAACCAAA TATACTTTTCTTAATTTTTGTCTGTTTATTTCAAAAAA CATCAGGGTGACTGGAACGGTGCTGGTGCTCACACT AACTACAGGTAATTACTCCCTCCATTCCGTTTTATAT GATCGCTTGATTAATCGTCAATGAGGAATACTTGAA TTACCTGATTTACTAATGCAATACTTGAATTTATTATC TACGAGTCTTCTTCAATGCCAATTTTATCAGGGTTTT GTTTGCTTAATTGTTCATGCAGCACTAAGTCAATGAG GAACGATGGTGGAATCGATGTGATCAAGAAAGCAA TCGAGAAGTTGAGCCTGCGCCATAAGGAACACATTT CCGCCTATGGTGAGGGTAATGAGAGGAGGCTCACT GGTCGCCATGAGACAGCCGACATCAACACTTTCTCC TGGGTAAACTTCGTTATACTTCAACTAACTGTTATTA AGCATTAGCTAGTTTTCTAACAAGAGACCGATTAAT CTTGTTTAATCTTACTGTTCTATGTATAATGTATGTTC ATTAGATTTGTGTAAGCTGTTTCTTGTATCGTACGAC TAATAATTTGATACGTAACTAATTGGAATTCAGGGA |

TABLE 1-continued

Glutamine synthetase gene sequences isolated from various weed species

| SEQ ID NO | SPECIES | TYPE | LENGTH | SEQ |
|---|---|---|---|---|
| | | | | GTGGCGAATAGAGGTGCTTCTGTTCGTGTTGGTCGC GACACAGAGAAAGATGGCAAAGGTTAGGAATTCTG TTTAATCTTTTCTTTTCTGCTTAACGTTTGTTTATGTTC TTCTCAAGTGCTTTTATTTCGCCCACATTATTTGGCTT AAGCTTAAATCACGAATTTTATACTCCGTACCACATA GGTACATATATATAGATATAGATTATAGCGGAATGA GAGTAAACACTGTAATATATAGTTCGAGTTTTGAAC CTTTTATTTGAATCAACGCGTATATTTTTTGTTACGT TAATAGGTTACTTCGAAGACCGAAGGCCGGCATCAA ACATGGATCCCTATGTCGTGACCTCCATGATTGCCG AGACAACTATCCTATGGAAGCCTTGATTGGAGAATC TGAACGAATTTGCATTGTTTAGACATTTCAACGAACC CACATCATGTTTATGTGCATTTGAATAATCATACATT GATGTCGTATTTGGGACTAGAATTCCTAAAATGCTT GACATATCGTTTGGTTGATCATTTGTGAGTAGTGTA ACGTGTACTCCTTTTCATCTCATGCAAGTGAATTGTT CTTTTAAGTTGGATTTTGTTTACCAAATTGTGATTGG TTGTTTTATTTATTATAATTCTTGCATTTGATTGAAT TAGAATCTATTCCGAAATTTGCAACTTTCAATCGATT TAACAAAAACATACACTAATCGTAATCTAAAGACAA AATTAGGGCAAAATCAAGGGGTTTTTCTAAGGTATA CCCTTGAAGTTTTGGGTTTTCCAAGGTCTACTTATGC CTTTTGAAACTTTCAAGGGATACCCCTGAACTCAATA CACATTATTATTCATATCCTCCCCTAGTTAAAACACTC ACCTTAGAATAAAATAAAAAATAAAAACAAAATAAA TTAAAAAGCCCTAAATCTCCTCCTTCCTCCCTCACCAC CATCCACTCACCACTGCCAACTGCAGCCAACCGTTG GACCA |
| 56 | Euphorbia heterophylla | gDNAContig | 2153 | CAAAAGCACTTTATCTTTTCATTGTATTTTCCTTTTGG GTTGGAAAGAGCATTTTAAAGTTAAGCTGAATAAAG GCTACAAAGTTGCACATTCAAACTATCCTAGGAAAT GGCAAAGATATGCTTTACGTATAAACTCTGCATAAA TTGTTGTTCACATGTAGAAGAGGGCTTTCGTTTTTGT AGTTTGCTATAGAATGAATGGGAAGAGGTCTTTGG GACTTCTTTTTGTTTCCAATTTCTTCCTATTCTAGGTG TTTTGTTGATATAATGTTCGTTTTCCATTAATTTGTTA TTGTGCAGTTGATAAATAAATAAAATTGTGCTTCTTA TTTTATAAGAATGTATCCCACTGACCTTTCTTTCTACTA CCTCTAAACATACTGGGCTTATATGTTTTCCTCGTCA GGGGTAATGGCGAAGAGATGGTTTTGTCAGACATG CATGTTAAACCTGGTGAACCTTGGGAATATTGCCCG AGGGAGGCATTAAGGAGGGCTGCAAAAGTGCTGAA AGAAGAATTCAATTTGGTATCTTTGTAATGCCTAAAA TGTTTCAATAACTTAGTTCTATCTATTTTTATATCTGA CTGTTTCGTGTTGCATGTTTAGGAATTGGATTCAGG CTTTGAGAATGAATTTTATCTCTTGAAACCTATCACA AGGTGATTAGATTGAACCCTGTTTTTTCTTTTCATTTT CCTTTGATTAGTATCTGATTGCTGGTTAATTATAGGG ATGGAAGAGAAGAATGGGTTCCATTTGATTCGAGCC CATATTGTTCAACTTCATCTTTTGATGCAGCTTCTCCC ATCCTTCAGGAAATGTTCGGTGCACTGCAGTCTCTA GATATTACAATGGAACAGGTAGGGAGTGAATAATA TTTATTGTTGGCCTCTGTATGTTACTTTGAGAAGACA AAAATATTCTACTGTCACCTGACCTCTATATGTATCTT TATAAGCTTAATTGTCTAGAGAATTTTATCTTGATAA CCATCGGTGGACCTATGTTGTACCACAGTGATGCAC GTGCTACACGTAAAAAATTAAAAATATATTGGTGAA ATGGTCAACTAAAATTATATAAAATATTAGAACCCTA ATTAATTTATACCATATCTTATAAAATAAAAATAAAA AATATATTCAAATGTTACTTTATACATATTTTCATTTA AATTCATGTATTCACACAACCTCAGATAATTTAATTT GTATTTTGTAATTTAATGCTACAATTAATATATATATT CCCTCCGTTCCATATTGTTCTGTGCACTTTTCCCATTT GGACGTTCCATAATGATTTGTGCATTGTGCTTTATTT CATTTTTAGACATGCCTTTATTATTTTTAATAGGGT GGACCTACCACTTTCTCCATTTACACATTCTCTCTCCA ATCTATTTTTGCTTTTTGACCCAACTTCTATTATAATA TGTTATTCTTACTTTTTCCCCAAATAGTAAATGCACA AAACAATATGGAACGGAGGGAGTACAATAATATGT AAGTTATTTTAGTTGATACTACACTTGATATAATATA TAATATCTATTTTTGGTGATTCGATGTGGGTGAGGTT AAACACTAAATTATTTGTACATATTATGTACAAATAC AACTTAACACAATAATTTGTATTTAAGAATAATTTAC |

TABLE 1-continued

Glutamine synthetase gene sequences isolated from various weed species

| SEQ ID NO | SPECIES | TYPE | LENGTH | SEQ |
|---|---|---|---|---|
| | | | | CAAGAGGTTTCTGATGATTAGTATTGCTTTCCTATTC<br>ATTCTTAAGCGTTCCTTGAAATCACTTGTAGCCGAAA<br>GCTGTCTTTACAATCCTATTTCATCATAGAGTTTCTG<br>ATTTTCTAACTACTGCTGAATGCGAAGAATTTTGTAA<br>CTACATTGCTGAATGCGAAGAATTTTGTAACTACATT<br>GCTGAATGCGATGAATTTTGTAAACTACATTCTTAGC<br>AATGCATGTTAAATGATTATTTGACATGGACAAAAT<br>AAGTGTAACAATAGCAAGTTGATCGCCGATTGTGAC<br>ATAATTAATTAATCAAATTCAAAAGCTCTCAATTTTTT<br>TTATTGCAGGATATTATTTGAAAAGCTATTTAAATTC<br>TTGTTTTGGCTCACTTATATACAACCAAATGCTCTTTC<br>TCTCGATGTGAATTAGAAATCTTATTTTCTTCATTGG<br>TTTGGCGCCACACCTATTGTCAGTCCCTCTATATGCT<br>TATTACTTGTGTT |
| 57 | Euphorbia heterophylla | gDNAContig | 946 | AATATGCGTGAAAAGTACAATTATTAATAATTTGTCC<br>AATAAATATTTTGTTGTTAAAGATTTTAAGAGGTTGA<br>AAAAGTAGTATATTTTTGGTTGAAAAAGAATGGAG<br>AATAAACAATATCAAAACAATAAATAAAGCAGTATC<br>TAAAAGTAGAGTGTAATTTGTGTAGTCCACTCTTTAA<br>AAGAGTACCAAAAGTTGAGGACTTCCTCATCATACC<br>ATTTTATATTGGTTGTTTCAGACATCACTCTATATATT<br>AGGCGTCATTTTGCGATTCATTTCACGCATTTCTTGA<br>TCACATTCTCACAATATCTTTCGTTCTCTCAATATTTT<br>CCATAAACAATATTCACAACAACAACATGTCGCTTCT<br>CTCAGATCTCATTAACCTTGATCTTTCTGATTCTACTG<br>ATAAGATCATTGCTGAGTACATATGGTCAGTTCTTTA<br>TTATTGCACACCATCTTTTCGATTTTATTACCCAATGA<br>ATAAAGTTTTATTTTTTCTGGGTTTTTCTCTTTTAGCA<br>GAAAGATTTCATTAACAACTTAATTCACAATGAAGG<br>ATTTCAGCTTTTTTAGTTATGAATAGTTTGATGAAGA<br>AAAGTGATGGGTTGTATCTTATATATTTTATCTGTTT<br>GTTCTTAATATGGGATATTTTCCAGTGTTACAATATT<br>GCTTATTTGACTAGCAAAAGATATTTATCTTATTTTTC<br>ATTGAACAAAATATGCACATAATGATTTTCTTTTATT<br>GGAAGTCATAGTGTAGTAATCAAGAACTTGCTGTGA<br>ATTTATTTTCAGGATTGGTGGATCTGGTATGGACAT<br>GAGAAGTAAAGCTAGAGTGTAGTTTTTTTTTCTTTTT<br>TTGTTTATTGTATTATTTTTAACCTTAAACCTTCACCT<br>ACCAAAATGAATGAATAAATAAATAAATAAATTTTT<br>AGTTTATTATTACGTAAGTAC |
| 58 | Euphorbia heterophylla | gDNAContig | 375 | TTTTGTTGGTTGGAAGGAATGTTTTCTAGCTTCTATT<br>TCGCTTTCGTATGGTAACTTATTACTTTAAATAAAGG<br>ACAAGAAAATGATTTTTGATTTTGGAAAGTATCGAG<br>AAATGTTTTTTGAAAGCTATTTTCTTATGAATATACT<br>AAAAATGTGATCTAATCTTTATTAAATAATGCCATAC<br>TTGTCCACTGAAAATATATTTATTTGGGGGTCAACTG<br>TTAATTAATTCTTGATCATGGTTGTAACAGCCCACAA<br>GCTATCTTCAGAGATCCATTCAGGAGGGGAAACAAT<br>ATCCTTGTGAGTTTCGTTGTTACCTATTTCGTTCGTG<br>ACATCTGTTAGCATCATTGGCTGTTAGTAGGCTAATT<br>CAGTAAT |
| 59 | Euphorbia heterophylla | gDNAContig | 459 | AAAAGTTAATAGAGAGTGAGGGATAGCTCAAGTGG<br>TTAAAGCTTCCTTCTCGAGGTGATCCTGTGATCGATT<br>CTCATCCCGCCCTTGTATATATATAACAGAGGATC<br>TACAAATGATTACTCTAACTGCAACTTATCTCATTTT<br>GCAACTTTCAATAAACTTTAGTACTTTCCATTACCTTA<br>ACTCCTTTAGTGTTATGGATTTGTTAACAAACTCCTT<br>GATTTACTTTAACAAGTTAATTTCCCTTTAAACAGAG<br>AATTACTGAACAAGCTGGTGTAGTTTTGACTCTTGAT<br>CCAAAGCCCATCGAGGTACTAATAACTTTTCTTTTGT<br>ATTAGTAATACGAATTTTTCATGTGTTATCCGTCTGA<br>AATCTTTGCAACTCGTCAACAGGGTGACTGGAATGG<br>TGCAGGTTGCCATACCAATTACAGGTATCTTCTTGAA<br>GAATTTAGTATTTATTC |

SEQUENCE LISTING (2056 sequences)

SEQ ID NO: 1 - DNA, 1759 bp, Amaranthus palmeri
attattccacactccacactacccatttcattctgctcgctctccttccttctttctcactcctttatctctctatattcatctctctctctagcttgttcacgacgccgaccacccttttccgatcccaggtaaaagtgaccaaacatggcacaaatacttgcaccttacatgcaatgtcagatgaagttttcaaaaggctccacaagttcaatgacatcaaatccttggacttcaatatttcttaaagaaaataaaaagggatcaattaaatgctctagtaagttcagagtatgtgcttctctccaatctgataatagcacagtaaacagggtggagcagctactcaacttggatgtcactccatacactgacaagataattgcagagtacatttggattggaggatctggcattgatgttcgtagcaaatcaaggacaatctctaaacctgttgagcacccatctgagcttcccaagtggaattatgatggctcaagcactggacaagcgccaggagaggacagtgaagtaatcttataccctcaagcaattttcaaggatccattccgtggtggtaataatatccttgtaatctgtgacacatacacaccagcaggcgaacccatccccactaataaaagatacagggctgcacagatctttagcgacccaaaggttgtttctgagattccatggtttggaatagagcaggaatacacgttgctccaacaaaatgttaaatggcctttgggatggcctgtgggagcctatcctggtcctcagggtccatactattgtggtgctggtgctgacaaatcttttggacgtgacatatctgatgctcattacaaagcttgcttgtatgctggcatcaacattagtggcacaaatggggaagttatgcctggccagtgggaattccaagttggcccaagtgttggtattgaagctggagatcatatctggtgtgcgagatatattcttgagagaattactgaacaagctggtgtggttctgactcttgatccaaagcctattgagggtgattggaacggtgcaggttgccataccaattacagtacaaagaccatgagagaagatggtggttatgaagcaattaagaaggcaattttgaatctttcattacgccacaaggaccatatcagtgcatatggagaaggaaatgaacgaaggttgacagggaagcacgagaccgccagcatcgacacattctcttggggtgttgccaatcgtggttgctctatccgtgtgggtcgtgacacggaaaaggcaggaaaaggttatctggaagatagacggcctgcctcaaacatggacccatacgtggtaacaggtttgctcgcagaaactacaatactttgggagccaacacttgaggctgaggcactcgcagcccaaaaactcgctcttaatgtgtaattcattcataaatcgtaccagagtatcgcatattcatgaacgagggaactctttcacgtgcccagaattcgcttatttttagtttttagtatcctgggtatgtgagtgttttcattcatgacatttgcttccgatcattgtttgttttgggaattctagagaataatttgtaactgttgcctttatttttgctcttatgaagctcaagctcagtattagttatattccagtttaaggaatgaacttcaaaatcgtttgttactcatcttcaactccattgaatacaaacttaataacttatgtcttagtttgctac

SEQ ID NO: 2 - DNA, 8486 bp, Amaranthus palmeri
catgtaaaaatcaatgtgaacacaaaacccgattttgaacctacccgaaacacctgaccctaaatcaactcgatgacccgaatgaacatctgtaggtgggagtaacaatcacgttttatgagtccatttcccctttaggatattgttttctctatttggctttcccaaaaagtcaatgcttggctttagattgatacaaacaatgagcatgcatgtgagtgacagaatgagtagacacaaacaagaaccctaattaaatatctaaatcattacatacaatttgattttccattaatttagtccagagattcttttgcattctccaaatcttgttcagattgtttattcaccactcaatttcagcatccctatcctctatggaagagccacacttcattttcaaccattattccacactccacactacccatttcattctgcttactctccttccttctttctcactcctttatctctctatattcatctttctctctctagtttgttcacgacgccgaccacccttttccgatcccaggttctgctgtttatttagctttttttggttatgtttgcaattgactgttgtgctgcttgtagtatcagatttgtggaattatcagtgttttgtgtttgtgtgttgaaacatggcaaatgggtttgcattgtgttaattttttcttactcggattgacattgaccgatcaactcattaccgctaaaacacccttttttttaatggtggaatggcatttgttaaatgttagtcgttttggtatagtagcttcagattaagactgcataatgtttactggagctgtattaagatgctatattagggtttttgctacacttgaacatgggtaaatggtacccaattggttgaaacttgaaactaggatatttcaattgtgatttttccctttgtttgactttccccggatgctttgtgggttgatattggcgtggtaatggggaagatcaattgttttaggatcaggatttaggtattcattacctctaaactccctttatggtatgatttgtcgccttccttccctttccagaccctgatcatagtttccttatgagtgggatacactagtcaagatgatcatgatgatgatgataattttagctattccttgtgctagagtcattgatcagtgttacaaatttcccaaacaaatttgatgagatggaagataattattaaagctacattttgtcggaatactattgaaattaatcacttgttagaatatgtaagtaggttattacattactaatcacttgttaatgtcattttaatatggagggagtatggttttgtggttttcctagctaacaatctatacctgcggtcctgctggctatttctttccaggctcatgttagtatagtgtataagtggccccaacttatcagaaagatggattttggcattaactatgtgactatgtccaagtatattgaacacttttatttctagtttcatttatctcctgtacttatttgagacctgctcttgtgcttcatataaaaaattacacaaaggttacaaaacactgttggactaaaacataaggaactcgcctttacaacaattgaaattttctcatctcattcatatagtgagctactatttgtgcgcgagcgattaccgaatagtgattacatcatctcttttgcctatgtgtttgtattacttgcatttgcatactcatgtcatgtacatgtggattttcatgctcaaacttgaatactttatgaagacatatctgaaacacatgtgcatttgtattaccacatttttttatccaaaatgatattccaaatgtattgtatgtcggggtgcccagcatttaatccaaaagtttcataaaccttgagtgaccgagatgcaaatctgtggcaatctgatctaaaggtttcataaatcctagaattcaaagcagacatatctgaaacacataaattaacgtgttatgcccatgtactcgaaaatgtttcctggaaactgagattggtttttcaacataagttgactcttgaccattgtgtgtttggttagcaatctacctgagtaacccacatatgtaaaaccctaacatattttatttgtgttgtaggtaaaagtgaccaaacatggcacaaatacttgcaccttacatgcaatgtcagatgaagttttcaaaaggctccacaagttcaatgacatcaaatccttggacttcaatatttcttaaagaaaataaaaagggatcaattaaatgctctagtaagttcagagtatgtgcttctctccaatctgataatagcacagtaaacagggtggagcagctactcaacttggatgtcactccatacactgacaagataattgcagagtacatttggtatatggttttcctttctataggccagatgtcacattaattttttttagctaatgtttgtgctacttttagttttttctcatctgtagataagacattcttggtggtttctactttcaatctgattatagaactaattgatctacgattgttctttggaacaggattggaggatctggtattgatgtccgtagcaaatcaagggtacaataacactgatgctgtcgatttattgttaaaccagcatttagatgttaagtttacttcattttttccctgaccgatgtttcttaatataccagacaatctctaaacctgttgagcacccatctgagcttcccaagtggaattatgatggctcaagcactggacaagcgccaggagaggacagtgaagtaatcttatagtaagatcttggggcagctataaacctttattactttgctcaattattgttgtccttgtttttgcttgactatcttttggggcttgagagttcttgtcactgaactaactcaaaaagcttaagctttcatttgagtcgattccttgacatggtatgggaaggttagcttacgggtttgaatctcatttaccctccgggaattattattactaagtaaatgtgtcgtgtccacacttctagttagggctttcgtgtgagggggcgtagtaggacctcaaccatcaacttaagatttatttgagttgattcctagaaaattcttgtcactcattaattcgtaatcatgtcattcatatgcagccctcaagcaattttcaaggatccattccgtggtggtaataatatccttgtgagtcatattctttctgactgttgtgaaactcaatatttattccaaaattatgatgttacctcaattgttgagattagaattttaattatgcattgccatgtaaatttaggtaatctgtgacacatacacaccagcaggcgaacccatccccactaataaaagatacagggctgcacagatctttagcgacccaaaggttgtttctgagattccatggtaagaaattcccatcattgacaatattttgttcctaatcatatttcctaatttaacactctccactgcaagggtgaactttatagaaagttgacccactatctgagaaatgacaaattaaaaactgatttctctagttttctaataaaagacaatgcataaattatgtgatggataccactaagggaataacctcaccaaagttcacttaaatttgaaggttaaattgtgggatgtacaatctaaactctcaatgtttcttttggattctagggaatgcttatccaagcttaaaactgatctttttgaattttgagtaagattgaactccgaattcattcaaaattttcaagagctcgtcaatattacaactcaagctttgacaaaatcaaaacaatcattcgtgtaaacacaatgaatttgtttaaggtgttcaactttgtattctctaaataatgcatacaacctagggccccaggctacttcaacgagaacatacctctagtccgactcttactaggaatttcctaaataatgctaaatcaaatatcttctggattgatttagctgcaagtatcaaacaatatattactattactcgaattaaaaagtaatcctacccttatccggagtgtaaaaatatccggctatcctgtaagaaaaccataacctaaacctacgtctactaggatatggtcaaactatgaagaagcttccaaggatatttgacatggatagaactttgacttttaactcatacaagccaacatcactttgcaaacaagtgaataaatgatccaagctgggactacggagaggacaaaatgcgcacttgttcacattagaaaaattactaacaggaagtattcatttgaacaagctaggacttcaagtaatgcctttgatcttgtgtcaatggttagcagtcgtaatacagtatgtcacacttgtaattaacataacaaatctgttgttttaaatatgacggtttgaatacccatgttctacgggaggcatttcactataaaggtcaaccgtttttgcctagtttggagcttgacaattgcaaaagtaattcaggggtctgcttttctagaattctggatcattatgagtctcttctgctctttgttttcgcctttcttttttcactctctagtctctacttttgggtttattctttatattatacttttgtaggtttggaatagagcaggaatacactttgctccaacaaaatgttaaatggcctttgggatggcctgtgggagcatatcctggtcctcaggtgtgttaattccccatattatcaacagtttctttgaagataatgctttgtttctgttatataatatgatttttttgatatgtctagggtccatactattgtggtgctggtgctgacaagtcttttggacgtgacatatctgatgctcattacaaagcttgcttgtatgctggcatcaacattagtggcacaaatggggaagttatgcctggccaggtgtcctctcgtatcattcttatgtcttattgctatttaatatgtctttgaagttggttatgaatagctacatctgcttacacctgcagtgggaattccaagttggtccaagtgttggcattgaagctggagatcatatctggtgtgctagatatattcttgaggtattctcctgaaatttgtatgtttgcccctttcaagttatattgtggcaactttgagtacattcgaatgatcaggaattcagtcttagtggttaattttataatttttactaagagaactgataaattaatcgacctgacattgaaattgtgcgtgattctctgatcaaatggggaccacattatgatagaaataatatgcattattatgacccatatttagtctacaattgattcaatcaaaaatccttatggaccagaaaaagaaattgtaataatgattctctaaaaatttagttgaaatgttgaatataggatcaagcgtgatccaaacccaatcaagatggtataaggtgtcttatcatctatgtttgtgagaaaatgagttgtatcagattaatgggaaacaacggatggaagttgatcacttttaggcacataaacaacaaactttcttatataatgtatatactccttcggatgcgtaattttattcaatcaagctgttcaacaagattaagctacatgtccttttgttttgtatgggatgaaccagaaaactctcatctttttatgaccctcacaaaccattaacaatgtctatttatagagcatgtgtgaatcttagggcctaggggtgttaacgagctaaaccaagccaagtcgggctagtgtgagtgctcaacttgacttcatgtttttcaaactcaagctaaatatttggatgttttagctcaaaatttaagcttcaaatctctatttggtgtgatactttatatatattaagagttaaaaagtttcactaactacatattagaatatgcattcgtattgtataaaactttaataagattttaaaatctatttaaaaacgattctaattctcaaaacgaatattgataaaaccattttgagtatattcacgagcatatcaagctgaatgagttggtttgcctcttaatcttagtttcttaaatgctcgataagcaccgaggcacacaaggtcctcggagcctaggcgcatatcacaaggcaaaaatgcgagttttttgtaggcaaggagcaaatcttcactaaaaaaatattaaatatcaaatttaaaacataaatatacttatattcatattataatagcaacaagcttgaaaatattcgttatcattgttgtaaacactaatttagcatataagtgatatgtttgaaaatgtgaaaatacccagttatattcttcttcttcatgtggttgtctagcctatttattatgcaagcaataatttctcgaacttcatattcaagtgaatttgggtttctatgttttatttattttcaaacaaacaagtttaagttaatgtccaagcccaacaaggaggtgtattgagcgcacatggcccgaaacgcgtcgaggcacaccaagatgcgcgcctcttatagtggtttttgcctcaccttgctaaggcgtcttcggccgtgcaaagcaatgcacactttttaaaactaagctcttgataatctgagttgtgctcaaatagtttgcaaatcgtgtgggatcataaatacccctccattaagcagtagagattcacaatttcatttcatttgcggtgtatcctcaaatcgctgcacctgtaaaggcagctgaaccaagatctcagttttttattgactgtctagtctgtagaaaaattaagagatatcaccattcaagctattttaattgaatttaacaagctttctctccttcaaacagagaattactgaacaagctggtgtggttctgactcttgatccaaagcctattgaggtactgccttgtccttttgtatttcttatgagcagctgtcttttctaaagaaccagactgaattcctctccaatatctgcttttttcaacagggtgattggaatggtgcaggttgtcatacaaattacaggtatctcgaatgttttaaatattttatactggttataatacacgtagccccttgaacaggatatattactcgaaatggtattaaatttgtaattcatggcaaaccacacgtcaatttattttgtaaatgacaaatacttcttttagcattatggcatatccatcttaatgcagcacagtacactattgaattagcattccaaaacttcgaatatcgcctggctgtcttaagtacccttatatagacatttaaatctatacttgttactgtaattgctagtgtctatggaattcactatacttcacatagctgagttgaagttgatgttagtgtctgtgatttttgtagtacaaagaccatgagagaagatggtggttatgaagcaattaagaaggcaattttgaatctatcattacgccacaaggaccatatcagtgcatatggagaaggaaatgaacgaagattgacagggaagcacgagaccgccagcatcgacactttctcttgggtatacagatatatatgccttttcttgacgtcatgttgaatatattattttgcatattatctaacaaaaatatgattttttttgtaactttcagggtgttgccaatcgtggttgctctatccgtgtgggtcgtgacacggaaaaggcaggaaaaggtaatagtatcctcttggaccttggttaaagactatgactactgattggatgttctttttgtttgcattttgctccccggatttagaaataactctttctcccatttccgtgctctgcagtgagtaacaaccaaatagaattcactccttccgtttttctcaattcaccgcaccttctatttttgtctatccccacgaaactgccccattactattttcggacatgactcactactttaacacatctttactctcgatattctctctcttatttgcaaatgaccccaccattaacccattcaacccaacttttaatcgccgtcccattcccacttggggcaaaatcacaaggacaaaggagtacaaatcaattgcaatcctggctagttctgatttccaatctccgatttctctgcaggttatctagaagataggcgacctgcctcaaacatggacccatacgtggtaacaggtttgctcgccgaaactacaatactttgggaacccacgcttgaggccgagtcacttgcagctcaaaaactcgctcttaatgtgtaattccaaccataaaatgaaccagaatatcgcatattcttgagcgaagaaactgtttcatgtgcccagaatttgcttgtttttagtttttagtatcctgggactgagactggcactggggctcaaaaacctttgcttctggtagtttgttttgggagttagaagagaagaatagtttgtgattgttactaatttatgaagctcaagctcagcattagttctattccagtttaagg

SEQ ID NO: 3 - DNA, 6862 bp, Amaranthus palmeri
agctgtattaagatgctatattagggtttttgctacacttgaacatgggtaaatggtacccaattggttgaaacttgaaactaggatatttcaattgtgatttttccctttgtttgactttccccggatgctttgtgggttgatattggcgtggtaatggggaagatcaattgttttaggatcaggttttaggtattcattacctctaaactccctttatggtatgatttgtcgccttccttccctttccagaccctgatcatagtttccttatgagtgggatacactagtcaagatgatcatgatgatgatgataattttagctattccttgtgctagagtcattgatcagtgttacaaatttcccaaacaaatttgatgagatggaagataattattaaagctacattttgtcggaatactattgaaattaatcacttgttagaatatgtaagtaggttattacattattagtcacttgttaatgtcattttaatatggagggagtatggttttgtggttttcctagctaacaatctatacctgcggtcctgctggctatttctttccaggctcatgttagtatagtgtataagtggccccaacttatcagaaagatggattttggcattaactatgtgactatgtccaagtatattgaacacttttatttctagtttcatttatctcctgtacttatttgagacctgctcttgtgcttcatataaaaaattacacaaaggttacaaaacactgttggactaaaacataaggaactcgcctttacaacaattgaaattttctcatctcattcatatagtgagctactatttgtgcgcgagcgattaccgaatagtgattacatcatctcttttgcctatgtgtttgtattacttgcatttgcatactcatgtcatgtacatgtggattttcatgctcaaacttgaatactttatgaagacatatctgaaacacatgtgcatttgtattaccacatttttttatccaaaatgatattccaaatgtattgtatgtcggggtgcccagcatttaatccaaaagtttcataaaccttgagtgaccgagatgcaaatctgtggcaatctgatctaaaggtttcataaatcctagaattcaaagcagacatatctgaaacacataaattaacgtgttatgcccatgtactcgaaaatgtttcctggaaactgagattggttttttaacataagttgactcttgaccattgtgtgtttggttagcaatctacctgagtaactcacatatgtaataccctaacatattttatttgtgttgtaggtaaaagtgaccaaacatggcacaaatacttgcaccttacatgcaatgtcagatgaagttttcaaaaggctccacaagttcaatgacatcaaatccttggacttcaatatttcttaaagaaaataaaaagggatcaattaaatgctctagtaagttcagagtatgtgcttctctccaatctgataatagcacagtaaacagggtggagcagctactcaacttggatgtcactccatacactgacaagataattgcagagtacatttggtatatgttttttctttgctatatgatcaaaaatgtcgctgactctaggccagacgtaacattaattttttttagctaatgtttgtgctacttttggttttttctcatctgtagataagacattcttggtggtttctactttcaatctgattatagaactaattgatctacgattgttctttggaacaggattggaggatctggtattgatgtccgtagcaaatcaagggtacaataacactgatgctgtcgatttattgttaaaccagcatttagatgttaagtttactccattttttccctgaccgatgtttcttaatataccagacaatctctaaacctgttgagcacccatctgagcttcccaagtggaattatgatggctcaagcactggacaagcgccaggagaggacagtgaagtaatcttatagtaagatcttggggcagctataaacctttattactttgctcaattattgttgtccttgtttttgcttgactatcttttgaggcttgagagttcttgtcactgaactaactcaaaaagcttaagctttcatttggttcgattccttgacatggtatcggaaggttagcttacgggtttgaatctcatttaccctccggtaattattattactaagtatttgtgtcgtgtccacacttctagttagggctttcgtgtgagggggcgtggtaggacctcaaccatcaacttaagatttgtttgagttgattcctagacaattcttgtcactcattaattcataatcatgtcattcatatgcagccctcaagcaattttcaaggatccattccgtggtggtaataatatccttgtgagtcatattctatctgactgttatgaaactcaatatttattccaaaattatgatgttacctcaattgttgagattagaattttaattatgcattgccatgtaaatttaggtaatctgtgacacatacacaccagcaggcgaacccatccccactaataaaagatacagggctgcacagatctttagcgacccaaaggttgtttctgagattccatggtaagaaattcccatcattgacaatattttgttcctaatcatatttcctaatttaacactctcccttgcaagggtgaactttatagaaagttgacccactatctgagaaatgacaaattaaaaactgatttctctagttttctaataaaagacaatgcataaattatgtgatggataccactaagggaataacctcaccaaagttcacttaaatttgaaggttaaattgtgggatgtacaatctaaactctcaatgtttcttttggattctagggaatgcttatccaagcttaaaactgatctttttgaattttgagtaagattgaactccgaattcattcaaaattttcaagagctcgtcaatattacaactcaagctttgacaaaatcaaaacaatcattcgtgtaaacacaatgaatttgtttaaggtgttcaactttgtattctctaaataatgcatacaacctagggccccaggctacttcaacgagaacatacctctagtccgactcttactaggaatttcctaaataatgctaaatcaaatatcttctggattgatttagctgcaagtatcaaacaatatattactattactcgaattaaaaagtaatcctacccttatccggagtgtaaaaatatccggctatcctgtaagaaaaccataacctaaacctacgtctactaggatatggtcaaactatgaagaagcttccaaggatatttgacatggatagaactttgacttttaactcatacaagccaacatcactttgcaaacaagtgaataaatgatccaagctgggactacggagaggacaaaatgcgcacttgttcacattagaaaaattactaacaggaagtattcatttgaacaagctaggacttcaagtaatgcctttgatcttgtgtcaatggttagcagtcgtaatacagtatgtcacacacttgtaattaacataacaaatctgttgttttaaatatgacggtttgaatacccatgttctacgggaggcatttcactataaaggtcaaccgtttttgcccagtttggagcttgacaattgcaaaagtaattcaggggtctgcttttctagaattctagatcataaaagcctctttgatctgtgttttctcttttttttttccctctctactcttcgatttattctgttaattttacttctacaggtttggaatagagcaggaatacacgttgctccaacaaaatgttaaatggcctttgggatggcctgtgggagcctatcctggtcctcaggtgtgttaattccccatattatcaacagtttctttgaagataatgctttgtttctgttatataatatgatttttttgatatgtctagggtccatactattgtggtgctggtgctgacaagtcttttggacgtgacatatctgatgctcattacaaagcttgcttgtatgctggcatcaacattagtggcacaaatggggaagttatgcctggccaggtttcgtcttgcatcactctcatgtgttattgttaattaatatgtctttgaagttggttacgaatagctacctccacttgcccctgcagtgggaattccaagttggcccaagtgttggtattgaagctggagatcatatctggtgtgcgagatatattcttgaggtactctcctgatagttttatgtttgtcgattttgtgttaaattgtggtaaaccataaagtacatttgtttaattaaaaatttggccttagtggttaaaattatataattaaccttcaaactaataagtcaatagatttgacattgaagttgtggctgatcaagatcaaactaggaccatattatgatggaaacaaaaacataattttgacccatattcggtatgcgattgattcaatcaagaaacttaatggactttcgaaagtaaataaaataatccttctttatgaagaaaatttgaatacaggtttataagtgatccaaattcaagcccaatcaatggaagaaagcctattacacttctaggaacatagacacggcagttttcttatagaatgttattgactcatcgagagttgcaattaaacttggttgttcaacaagattaagctacatgtcttttggttttgtatgggatgcaccgtaaattctggtttttcctatgaccctcacaagccaagcctattgaggggatcagatctcagttcttttaatgattgtatactctgtagaaaaattgaggagatatcaccatttacaagctattttcattgaatttaacaagttttctctccttcaaacagagaattactgaacaagctggtgtggttttgactcttgatccaaagcctattgaggtaccgccttgtgcttttgtatatgtaatgatcagctgtctttcctgaagaaccagactgaattcctctccaatatctgcctttttcaacagggtgattggaatggtgcaggttgccatacaaattacaggtatctcgaatgttttaaatattttatactggttataatacacgtagcccttgaacaggatatattactcgaaatggtattaaatttgtaattcatggcaaaccacacgtcaatttattttgtaaataacaaatatctcttcttttagcttcttatgcatattccttagtgcaacaaatatcatttgccttttgttttagtactaatatatgttactgattttgtaagacattatgggatatccgtgtaaatgtagcacagtatctaatgaatcagcatccaagtgttcgaattttggttaactgcctcaaatctgatttttctgttggcgctcaaccaaaattgtaaaatgaatgatgttctcatgtacacgctagcctgtagcttcagccacaagtttgaacgagctacccatattttctcactgtacctttttgatatagattttatgctccgtataaccaatatttctgagatatgagatgaggcctatctagtgtggggtggataaaaagattttcaccgcaattctttttaaagcgttagtaacactaacatagaccttttaaactattcttgtaagcgtaagtactgtagttgagttgaaacattccgagagcttaattgtctcattttgccaacgctaagaaaattgatgagcaaggttgtaatttttgtagtacaaagaccatgagagaagatggtggttatgaagcaattaagaaggcaattttgaatctttcattacgccacaaggaccatatcagtgcatatggagaaggaaatgaacgaaggttgacagggaagcacgagaccgccagcattgacacattctcttgggtatactgatatatatgcctattcttgacgtcatgttgaatatattattttgcatattatctaacaaaaatatgattttttttgtaactttcagggtgttgccaatcgtggttgctctatccgtgtgggtcgtgacacggaaaaggcaggaaaaggtaatattattctctcgttggaagactatgactgtctcacattgtcgttgtctgtagtaagtaatgtccaaatataaaatcatcatcatacccaatatcccgctcgaaagcagggttgggtgagggaaggtgacggacaatccatacccgtaatcccttcacagggaggactagaacatactactcatttacacatcttgaatgaagcagtctcgtttcatggggtgacatcataatagtcggatataaagcaatatttatgatttccaaggtttgatttctctacaggttatctggaagatagacggcctgcctcaaacatggacccatacgtggtaacaggtttgctcgcagaaactacaatactttgggagccaacacttgaggctgaggcactcgcagcccaaaaactcgcccttaatgtgtaattcattcataaatcgtaccagagtatcgcatattcatgaacgagggaactctttcacgcgcccagaattcgcttttttttagtttttagtatcctgggtatgtgagtgttttcatttgtgacctttgcttctgatcattgtttgttttgggagttcaagagaagaataatttgtaacagttgccttctttatttttgctcttatgaagctcaagctcagtattagttatattccagattaaggaatgaacttcaaaatcctttgttactcatcttcaactccattgaatatacacttatgtcccgttgg

SEQ ID NO: 4 - DNA, 1618 bp, Amaranthus rudis
gggacaatcatactcctataacaactttaatcatacactctctcttctttatctctctatattcttcactctctctctagttagttgacgccgccgaccaccttttccgaacccagtgaccaattatggcacagatacttgcaccttacatgcaatgtcagatgaagttttccaaaggctcgactagttcaatgacattaagtccttggacttccatatttctgaaagaaaaccaaaagaaatcgattaaatgttctagtaagttcagagtatgtgcttctctcaagtctgaaaacggcactgtaaacagggtggagcagctactcaacttggatgtcactccatacactgacaagataattgcggagtacatttggattggaggatctggtattgatgtccgtagcaaatcaaggacaatctctaaacctgttgagcacccatctgagcttcccaagtggaattatgatggctcaagcactggacaagcgccaggagaggacagtgaagtaatcttataccctcaagcaattttcaaggatccattccgtggtggtaataatatccttgtaatctgtgacacatacaccccagcaggcgaacctattcccactaataaaagatacagggctgcacagatattcagcgacccaaaggttgtatctgaggttccatggtttggaatagagcaggaatacactttgctccaacaaaatgttaaatggcctttggggtggccagtgggagcttatcctggtcctcagggtccatactactgtggtgctggtgctgacaagtcttttggacgtgacatatctgatgctcattacaaagcttgcttgtatgctggcatcaacattagtggcacaaatggggaagttatgcctggccagtgggaattccaagttggcccaagtgttggtattgaagctggagatcatatctggtgtgcgagatatattcttgagagaattactgaacaagctggtgtggttctaactcttgatccaaagcctattgagggtgattggaacggtgcaggttgccatacaaattacagtacaaagaccatgagagaagatggtggttatgaagcaattaagaaggcaattttgaatctatcattacgccacaaggaccatatcagtgcatatggagaaggaaatgaacgaagattgacagggaagcacgagaccgccagcatcgacacttctcttggggtgttgccaatcgtggttgctctatccgtgtgggtcgtgacacggaaaaggcaggcaaaggttatctggaagataggcggcctgcctcaaacatggacccatacgtggtaacaggtttgctcgcagaaactacaatactttgggaaccaacacttgaggctgaggcactagcagcccaaaaactcgctcttaatgtgtaattcaatcataatcgtgccagaatatcgcatattcatgaacgagggaactctttcacgtgcccagaatttgcttatttttagtttttagtatcctgggtatgtgagtgttttcattcatgacctttgcttctgatcattgtttgttttgggagttcaagagaagaataatttgtaactgttgccttcattatttttgct

SEQ ID NO: 5 - DNA, 1550 bp, Amaranthus rudis
gatttcttaattgaagttcccaaaaacaaataacatactcatcttcctcttctcttattcatccaattttattcttccccaaaaaacatgtctcttcttacagatctcatcaatcttaacctctctgactccactgagaagatcattgctgaatacatatggattggtggatctggtatggacatgagaagtaaagcaagaacacttgatgaacctgtgagtgatcctaaaaagcttccaaaatggaattatgatggatctagcactaatcaggctcctggtgaagatagtgaagtcattctatacccacaagctatctttagagatccattcaggaggggcaacaatatccttgttatgtgtgatgcctatactccacaaggagagccaatcccaaccaacaagagacataatgctgaaaagatattcagccatccagatgttgttgccgaggaaccatggtacggtatcgaacaggagtacaccttgctgcaaaaggatgttaactggccccttggtggcctgtagggggtttccctggtccacagggcccgtactactgtggtgttggtgctgataaagcttttggaagggacattgttgattcacactacaaggcttgcctctatgcaggaatcaacattagtggaatcaatggagaagttatgcccggacagtgggaatttcaagtcggcccgtctgttggaatctctgctggagacgagttgtgggttgctcgttacattttggagaggattaccgagattgctggagtagctctttcttttgatccgaaaccaattccaggtgactggaatggtgctggtgctcacaccaattacagcaccaagtcgatgagggaagatgggggctacgaggtgattaagaaggccatcgagaagctcgggttgaggcacaaagagcacatctctgcttatggagaaggaaacgaacgtcgtctcactggtagacacgaaaccgccagcatttccactttcttgtggggggtagccaaccgaggagcatcagttcgtgttggacgagacacggagaagaatggcaaaggatattttgaagacaggaggccggcttctaacatggacccatatgtcgttacatcaatgatcgcagaaactactcttctttggaagccatagagcggccacgagcttaatcaagtaatttgctattaaccagcagatcgattcgcctcttgtgttctgcatctgcctattcaagttgttcgcctttttgttcattttttacacttccattcagaccgattatcatgtacaaaccgtcgcttgctgtttgctgtgcgcgggtaataacatcaaatcctttgtcgcttcgacaatattgaaaataacattgtacccttcttatttcttcctagaaaatatggaaagtcggagaggatcatttctctgccattattgtgatgaattttttttgcattgtttgcaatttattgtcttcaaatctttgagccttatctcgatcatctcgatcttaataagctattaatcgtatgtgggtgttttcaagca

SEQ ID NO: 6 - DNA, 2000 bp, Amaranthus rudis
tgtaataccctaacatattttttttgtcgttgggagaagtgaccaattatggcacagatacttgcaccttacatgcaatgtcagatgaagttctcaaaaggctcaacaagttcaatgacatcaaatccttggacttcaatatttcttaaagaaaataaaaagggatcaattaaatgctctagtaagttcagagtatgtgcttctctccaatctgaaaatagcacaataaacagggtggagcagctactcaacttggatgtcactccatacactgacaagataattgcagagtacatttggtatatgttttttctttgttatatgatcaaaagtgttgatgactttaggccagatgtcacattaattatttcaagctaatggttgtaccaatatgagtttctgctcatctgtagataaggcattcttggtgtttcctactttcaatctgattatagaactaattgatctacgattgtgctttggaacaggattggaggatctggtattgacgtccgtagcaaatcaagggtacaataacactgatgctgttgattgattgttaaaccagcatttagatgctgagcatacttcattttttctctgaccaatgtttcttaatataccagactatctctaaacctgttgagcacccatctgagcttcccaagtggaattatgatgggtcaagcactggacaagcgccaggagaggatagtgaagtaatcttatagtaagattttggggaagctacaaaccttattacatttgcttgataattattgtccttgtttttgagtgattatcttttgaggcttgagagttattgtgactgatcattaattcattattgtgtgtcatattttcatatacagccctcaagcaattttcaaggatccattccgtggtggtaataatatccttgtgagtcatagtctctgacttagtcatgaatcagaatatttattccaacgcttttgatgttacctcaattgttgagaatatcaatataattttgctatgcaatgtaaacttaggtaatctgtgacacatacaccccagcaggcgaacctattcccactaataaaagatacagggctgcacagatattcagcgacccaaaggttgtatctgaggttccatggtaagaaattcccatcattgacaatattttggtcttaattgcatttcatagttaacactttgcactgcaaggatgaattttatagaaagttgacacactatgagaaatgacaaatgaaaaattgatttctctcgtctttttttaaaagacaatgcatagacaaatgaaaaattgatttctctcgtcttcttctaaaagacaatgcatagattatgtgatgggtaccactaagggaataacttaaccaaagttcacataaatttgaagggtaaattgtgggatgtacaatctaatctctcaatggttcttctggtgtctagggttaaaactaatctttttgagtaagataagattgaactctccgaattcattaaaaattttcaagaactcgtcaatgttacaactcaaggttggacaaaatcaacacaatcattcgtgtaaacacagcgaatttgcttaaggtgttcaactttgtattctctaaataatgcatacaatctagggccctcggctacttcgacgagaacatacctctagtatgactcttattaggattttcctgaatattgctaaatcaaatgtcttttgatttaaaagtaatcctacccttatctggagtgtaaaaatatccggcaatccaacaagaaaaccacaacctaaacctacttctactaggatatggtcaaacgatgaagaagcttccaaggacatttgacatggatagaactttgagtattaactcatgcaatccaagatcaatttgcaaacaagtgaataaaggatccaagttgggacttaggagaggacaaaatgcacacttgtccaccttagagaaattactaacaggaaatatttcatt

SEQ ID NO: 7 - DNA, 208 bp, Amaranthus rudis
tgcagggggtagccaaccgaggagcatcggttcgtgttggacgagacacggagaagaatggcaaaggatattttgaagacaggaggccggcttctaacatggacccatatgtcgttacatcaatgatcgcagaaactactcttctttggaagccatagagcggccacgagcttaatcaagtaatttgctattaaccagcagatcgatt

SEQ ID NO: 8 - DNA, 1723 bp, Ambrosia trifida
ttttccctttttttattatatttatatttatttttatatttataaacaaccttttatattttatttgtacccattttacaacttccatttttctcccgccacataaccactttccggccacttctttggtgaaaatggcacaatgtttggcgccttcggtgcaatggcagatgaggttaacaaggagttcaatggaaacaagctctatgacctccaaaatgtggaactctttttctttgaagcagagcaagaaaggcgcgctcaaaacgtccacaaagtttagaatatgcgcttcgtcaaatggaaccattaacaggatggaagacctactaaacttggatgtatcgccttacaccgataagatcattgctgaatacatttggattgggggttctgggacagatgtgcgcagcaaatcaaggacaatctcgaaagcggttgagcatccttccgagcttccaaagtggaactatgatggatcaagtactggacaagcaccaggagaagatagtgaagttatcttatacccccaggcgatctttaaggatcctttccgtggtgggaacaacatactggtcatatgtgatacatacacaccacaaggcgagcctatccctacaaacaaacgtgctaaggctgctgagattttcagtgatcctaaagttgtcgatcaagtgccctggtttggaattgagcaagagtacactttgcttcagccaaatgtgaattggcctttgggttggccaacaggaggttaccctggtccacagggtccatactactgtggcgctggagcagataagtctttcggaagagacatatcggatgcacattacaaggcttgcctgtatgctggaattaacatcagtggaaccaacggcgaagttatgcccggacagtgggaattccaagttggtcctagtgtcggaattgaagctggagaccatatctggtgtgctagatacctccttgagagaattactgagcaagccggtgttgtcctaacacttgaccctaaaccgattgagggagactggaatggcgcaggatgccacactaactacagtacaaaggccatgagagaagaaggtggatttgaggtgattaaaaaggcgattttgaacctttctcttcgccacaaagaacacatcagtgcttatggtgaaggaaacgagagaagattgactgggaaacacgaaactgccagcatcaaccaattttcatggggagtagctaaccgtggttgctcaatccgtgtgggtcgtgacactgagaaggccggcaaaggttacttggaagacaggcgtccggcatcaaacatggacccatatacagtgactggattacttgcagaaacaaccatcctgtgggagcctagtcttgaggccgaagcacttgctgcgcagaagttggcattgaatgtgtagactcaagtcaacccatgatcttcgaaagctcggtgttctgtttctagtttgatttcttcaacatcttgtaaataaaggtccccacgcttcatgttcaacgctatttttagcgactgggtgcttttttttacaaatggttactggacagtttatgcacattttgatgtgtccttggtcacaactgagtcaactttattctcttcttgaattgtagaaaataccttcaggttttggggtaatctttatataaatatcgagcataaaacaccggcttgttaaaaaagaaaaaagtaccg

SEQ ID NO: 9 - DNA, 1000 bp, Ambrosia trifida
tattattattaactatgcaatatcctaactttttgttttttacgatataatttatcgctttaacagagaattactgagcaagctggtgttgtcctaacacttgaccctaaaccgattgaggtaatagaaatcaatttcaaccgttttaataaattattattattgtggcgaattggacgtacaaaaagataatattttttccattagttatgttagtgagcttatatctaactgcacaaattcttctggtttgcgctgacagggagactggaatggcgcaggatgccacactaactacaggtactcgctttctcatactaatcatcaccgtttcggaataaaaccaaaatattatcatgttttttcaacctttattacatttaaatttattttctaaacaatttgcagtacaaaggccatgagagaagacggtggatttgaggtgattaaaaaggcgattttgaacctttctcttcgccacaaagaacacatcagtgcttacggtgaaggaaatgagagaagattgactgggaaacacgaaactgccagcatcaaccaattttcatgggtatatatagaacactttctactcaattttataaaaaaaaagtgcgaaggtttcgtaagtttttctcaacttgtatattttgcatttggccaactttcagggagtagctaaccgtggttgctcaatccgtgtgggtcgtgacactgagaaggccggcaaaggtattgaattttttttatttatttatttttttttttaattcgaacatgcatagtaaacacataacctggttttattgaaataattctcctttgttctgattttttttcatggttaatttggattacgcgtaggttacttggaagacaggcgtccggcatcaaacatggacccatatacagtgacaggattacttgcagaaaccaccatcctgtgggagcccacgctcgaggctgaagcactcgctgctcagaagttggcattgaatgtgta

SEQ ID NO: 10 - DNA, 841 bp, Ambrosia trifida
ttaatgtgtaggttacttggaagacaggcgtccggcatcaaacatggacccatatacagtgactggattacttgcagaaaccaccatcctgtgggagcctagtcttgaggccgaagcactggctgcgcagaagctggcattgaatgtgtagactcaagtcaacttatgatcttcgaaagctcggtgttctgtttctagtttgatttgttcaacatcttgtaaataaaggtcccaaaaagtcatcatattcaaagctttttgtagcaactggttgtttttttatgagatgattattggacaatttatgcacattttgatgtgtccttggtcccaactgagtcaactttattctcttcttgaattgtagaaaataccttcaggttttggggtaatctttatataaatatcgagcataaaacaccggcttgttaacttgatttgcctctgtgttttttaattcagcggcgtgcatgtggctactaaattagtaaggattaaagtgtagatgttgttaacttatcataaggctagaacgtgtgaacacgagcatgatcaatataacaatggcaaggtccaaacccctgtcacttggaagtatgttggttggattggacggttataggtgttgagcatattattttgccaacccatcacgcgtatgatattttggtcccgacccgtttataatacgtcaacatgtatgtggtcattcatggttctatttgatgtcaaagtgcaatagatgagtatattgtgaaaccatccacttgtcatgcacttagagtatgtttggataaacttatttgagtccaaaaggactttttgttaaaaggacttatta

SEQ ID NO: 11 - DNA, 1955 bp, Conyza canadensis
catggatggattctacattgcccggtactaacgtactcgtaggagctcatgacagcaaaaatgggttccagcatcttggggagcttggaaaagggaatcaaccatacccacacccctatctctttaggaaaggccaatctcccctcctttgttttctccttttattttttatatatactttttattaaaataaaacatatactatttatttatttttacatccatttatcaaacaaacttgcaactttcttcttttcattcattttgccgctctcaaccatcacttttctctactttccggccggtgaaaatggcacaatgtttggctccttcagtacaatggcagatgaggttaacaaaaaatggtatggaatcaagctctatgtcatccaaaatgtggaactctttgtccttgaagcaaagcaagaaaggagcacttaagaacgccacaaaattcagcatctgtgcttcagcaaatggaaccattaacaggatggaagacctactaaacttggatgtcactccttacaccaataagatcattgctgaatacatttggattggaggttctgggacagatgtgcgcagcaaatcaaggacactctcaaaaccagttgagcatccttctgagcttccaaaatggaactatgatggatcaagtactggacaagctccaggagaagatagtgaagttatcttatacccccaggcaatctttaaggatcctttccgtggtggcaacaacatcttggtgatctgtgacgcatacactccgcaaggcgagcctatccctactaacaaacgtgctaaggctgctgagattttcagtaatcctaaagttgtatcgcaagtgccctggtttggaattgagcaagagtacactttgcttcagacagatgtgaagtggcctttgggttggcctgttggaggctaccctggtcctcagggtccatactactgtggtgctggagctgataagtcgtttggaagagatatatcggatgcacattacaaggcctgcctgtatgccggaattaacatcagtgggaccaatggagaagttatgcctggacagtgggaatttcaagttggtcctagtgtgggaattgaagctggagaccatatctggtgtgctagatacctccttgagagaattactgaacaagctggtgtcgtgttgacccttgaccctaagcctattgatggagactggaatggagcaggatgccacactaactacagtacattggccatgagagaagaaggtgggtttgaagtaattaaaaaggcgattctgaacttgtcacttcgccacactgagcacatcagtgcttatggagaaggcaatgagagaagattgacagggaagcacgaaactgccagcattaaccagttttcatggggtgtagcaaatcgtggttgctcaatccgtgtggggcgtgacactgagagggaaggcaaaggttatttggaagacagacgcccggcatcaaacatggacccgtacaccgtgaccggattactcgccgaaacaaccatcctttgggagcctacccttgaggctgaagcacttgctgcccagaagttggcattgaatgtgtaagactctcccacgaggtgatatacaacgaagaaagtgtcaacatgcatattcatccatgttcttcgtaaactcggtttcctgtttctagttgatttcttgaagatcttgtaaataaaggtcatcactgcttcaaattcaagctatttttagcaaatgggtgtttttcagatgattattggacagtttatgcacaatttgaagtgtgcacaagtgcacttgacccggtctgagcagacattattttctcttcttgatttaaagaaagcaccctcacattttgggggtattttctcttcatttgatcatatcatataattatcaatcggtttagatgggctgctgctcctttttt

SEQ ID NO: 12 - DNA, 8676 bp, Conyza canadensis
aaaaaaaaactttaacctttttatgatcatgtggtttgaaaagatggggcttgaaaaggttcaaaattttagacctttccaaaattagataatttattatttttttctttttaagaattaagacatttaatttatttagaaagctataagtgttgaatcatcatgaaaattggcttataaaaatatgttaatattaatattatgaaccttcagaaagattttatgccataaatattttttatgtatgatgactgatgatattgtgtaaatatcatagattgaagaccctttcaaactttaaaaacggtgttgatatcatcactatttagaaaaagaactctttttttttttaatgtgatttatctcaaactttttatttaaatcgttaactacctgatcaacaggcggatttaagtacaactaatatcacacaaatgtccaattaaaaaatcatctcataatctatatggtccataacaaaagttgataacaacaaagttattaagcacctgaatatacttttgtaaaaggttagctagaaaaagacaatatatatcataccatcagacttctacttgtggaaataacgttaccaagcacatatttccatatgaattacaacatgctaacctatattaaattacgtctatgatcattaacccaactcgatttggtattgtgatgtggtgattataacttacaacaaagtacaatatgataaaacttgctttttttatattattattatatccaaagtctctatattaatcatatttaaaaaagctattgacaaatcataacaaacaacacatttaagttccatatatactatccatgaatcaatcaatgaatccaaaattttattttcatgatgataaaaaggaaaataagaagaaaaaaaaaatagtttgaggttgtgagaaaaagccttatctagtttctcatcatatatgttgagttgaggcaaggaatgaaagggagaggggggcttttgttttgttatgatgaccttaaaaagagaccaaaaaccaatttcctccacccacacccctatctctttaggaaaggccaatctcccctcctttgttttctccttttattttttatatatactttttattaaaataaaacatatactatttatttatttttacatccatttatcaaacaaacttgcaactttcttcttttcattcattttgccgctctcaaccatcacttttctctactttccggccggtacgttcctccctccctccctacattacgtcattgttttactcatcactatttacacacaaacatatgacttaatgtatacatataattttgtacggaacttttgcgatttatcagccgcacactcgaactaaattttttgatcggaaatgtagccattatatatatatatacacacagagagagtatattaaatatatatatatatacacagagagatatcaaatatatgcatagcatatatatgcgtgtgtgtgtgtatgtatatataactttgctagtgttaattactcgaaatgacgatgtataacaagtagtagtaaatcagtagaaacggcgtcgtcctattagtgtatgatggcaactacaagtagtaaatcaagcctaaaagtttgttcaatattaaaaattaaaataaaaaccaggcctgaaaatgtggaagggttgttagtggttaaattagttgacctggatggaggtaggtcagatgataatagtagctgttgatccaggccaagtggaggatcaccacacacttgtatctactcttgattattttattatttttaaactgctacttttgattaatcattaatttcatatgaacattttaatataaacatttttgcatctgaaaatgtttttccatctgctaaggatgaaaggaccaaaatgcccttccatgctgttcaatgtttttcataatttaaaaggttatatatatatttactaatctagctagtgattatatatgttgccttttgaatctgatgatctttttttggccagctacttgaatattgttaaataaatttagaaaaataaatatatgaatgataagttttaacttttaggtaaaaggatcttgataagcaatagctgaaagtccggagctagaaagggcttggtattggtgggacgtaattgaaaagatatacaaaattaaacatttatgatttttgcatctgtttgtatttagtgtgtcgaatgaaaagtaaatgtataaagagttgtgataaatttttggatccgaactggtacagtggtacattacagacacgggcgaaagcttggagtgttactttgatcctagatcttaatagacgagattcgttacatattaactaataatagaaatgcagcaatgccccccttgtttatattaaagattcatttttctcatgtgtgaattatgattttttgataagacaaaagttgtttacttgaagttgaatgatgtgggttcctacttgttttaaaaatgtgtaacctcttatctaaaaactctgtacttacgatgatcacaagaacctgcattgctgaccatttatcttatttattgatatttttgtgtctgataatatgggtaggtgaaaatggcacaatgtttggctccttcagtacaatggcagatgaggttaacaaaaaatggtatggaatcaagctctatgtcatccaaaatgtggaactctttgtccttgaagcaaagcaagaaaggagcacttaagaacgccacaaaattcagcatctgtgcttcagcaaatggaaccattaacaggatggaagacctactaaacttggatgtcactccttacaccaataagatcattgctgaatacatttggtatatttcattctttggatacacttaccatacaaatttcaggcttactaacatattaacaaaagtttgttacgttactctaaaggcttgttcaattcttatttagtcctatgctttctactttctgaaacaggattggaggttctgggacagatgtgcgcagcaaatcaagggtatgttgggttttgatgctttggtttctttcagtaattatctatagcttcgctaaaaggaaagattgtaatatatgtttcattatatctcttgtagacactctcaaaaccagttgagcatccttctgagcttccaaaatggaactatgatggatcaagtactggacaagctccaggagaagatagtgaagttatcttatagtaagttttatttcaaaaaatcacaagtctctttacatgtggtgatgtaaccaaagttgaaattctgtatttcagcccccaggcaatctttaaggatcctttccgtggtggcaacaacatcttggtgagtataacgttggttcattatactataaagtcttatgtataagctgagaaactcccaccaaccaaaaggttgcagtttcgagttctatatggacaagtgcatgcgaattttttccccttgaaaaataaggatacaaactgaaattggacaacatatggcttaaactgattctgtactgtttttataggtgatctgtgacgcatacactccgcaaggcgagcctatccctactaacaaacgtgctaaggctgctgagattttcagtaatcctaaagttgtatcgcaagtgccctggtaggctttttgggtgaaaatgttcttttttttcccccatagaactaaactcttaaatccctgtgtttgataattgatacatacattaaacttcttgtcacatgaataaggggcagataggtctgactttattagtcaacatacacctcccttttatgtgaacggggatactctactaaaacaacaaaataaacaaatattgcctctgtttatttcccggtaaaattgattttaaatttggttttaggtttggaattgagcaagagtacactttgcttcagacagatgtgaagtggcctttgggttggcctgttggaggctaccctggtcctcaggtactattcatgatctaacttttgtaaacttctacaccttcctcatttataaatgggatttaatatcagttaaagctaaaggtggcaaaatgagtgggctagattgacctgaaagacttttttttaaactaattttttagttttccctatttataattagtgtgccaaatattgttataatcatttaatttcaaaaatagtttatctttttttgagtaaccattatactaaattcactcgtttgaaccattagagataaagcataactgaagagcgattctttcataagcaatgaatgaaattttccacccttaaaaacaagtgttcttattaaatgtatttccttttgaaactacagggtccatactactgtggtgctggagctgataagtcgtttggaagagacatatcggatgcacattacaaggcctgcctgtatgccggaattaacatcagtgggaccaatggagaagttatgcctggacaggttttttttctacttcttcaccttattatctaatgaattatgaaaagaagtatcatggcaacaattgtgtttcacagtgggaatttcaagttggtcctagtgtgggaattgaagctggagaccatatctggtgtgctagatacctccttgaggtaaatcatcttcagcaatttgatacagtaacaacttaatatatcctaccgtgtttttttaatctatatctaattgtttcttgtgactttactgtatttaacagagaattactgaacaagctggtgtcgtgttgacccttgaccctaagcctattgatgtaagatatatcttgtttgatgactactttccttcaattttccatcatagtgttcaaatcttgcttagggagaacatttgagcaacatgtaatgtcactcttttgtaattagaggtggttagataggcatgttggttaatgtgtccaaatgtacaattctttgatgacacaagcttagttgaccataaacacttttttccttttgtttttcttacaaaaaagacgaacaagataattggcaattcaagctatattaaaattcaaaaatttaaactttttgagtaaaaaggaatttcaggaggtgttatgagctaataaaagtatacattttaggtcactcatttgtgtcgatttcattttaagctacttctattgggtttaacaatgggaggcacagaaaacgcctcagttgaccctttgataactaaacgggttgaatttgccacctctacccgctctgaatgattctgattttattcttaacttacacaacgcttgttgatttgaattggcagggagactggaatggagcaggatgccacactaactacaggtacttgttttctttactcataatagacctgcgtattgtttttgaaacgctctaatgtgtgtgaacgttgatttctttcttatattaaaaatccattcacttacttttgtgctttcaaatttcagtacattggccatgagagaagaaggtgggtttgaagtaattaaaaaggcgattctgaacttgtcacttcgccacactgagcacatcagtgcttatggagaaggcaatgagagaagattgacagggaagcacgaaactgccagcattaaccagttttcatgggtataaaacattttatatcgaattataagagataaaccaaaaaaaataatttacactttcataagctttctcaactgatggtttttgtattcggtgaacttgcagggtgtagcaaatcgtggttgctcaatccgtgtggggcgtgacactgagagggaaggcaaaggtattgctatcttcacactacagtctttatcattggtggataattggatattggtaactcgtcaaactgggtaaatatatgttatggttcaacgtgttgggatgaccaaataaacattttatataattatcaaaatcttcataaacatattgttaatataccaaacatgtttccagaaattataaaatttcaacagtaatctgccttcttgaattaatcgatttaggaggtgtaatgcattagaatcacaaatcgccaactgattttatttttattttttctttctgaaataacctaaattgaccgttcattagtgagtctaaatttccacctttaaaaaaattctctttcgaaatctgttttttcacgggtcatgtttactatgtgcaggttatttggaagacagacgcccggcatcaaacatggacccgtacaccgtgaccggattactcgccgaaacaaccatcctttgggagcctacccttgaggctgaagcacttgctgcccagaagttggcattgaatgtgtaagactctcccacgaggtgatatacaacgaagaaagtgtcaacatgcatattcatccatgttcttcgtaaactcggtttcctgtttctagttgatttcttgaagatcttgtaaataaaggtcatcactgcttcaaattcaagctatttttagcaaatgggtgtttttcagatgattattggacagtttatgcacaatttgaagtgtgcacaagtgcacttgacccggtctgagcagacattattttctcttcttgatttaaagaaagcaccctcacattttgggggtattttctcttcatttgatcatatcatataattatcaatcggtttagatgggctgctgctccttttttggtcaattttattactagattgcttgtcaatgctaattatttcgttaaaattggaaaatgatgtaattcatacttacaattcttactgcgaaaagggaggctaaataacagtagaacactagaacttcaacaacaacgagagttataatacaagagagttaaataagcatttatataacttaactaagtaaaatatacaactatctcttttgccctccctgcttgaaaacaatggacttaatattgtggaatcacagtcaggaatctcaacgagttaaaaaaaatgacgatgatgtacgttaccattttttagttatacatcacaaacatgtgttctatcatacaatgatgtgaaacatgtatgtgttggtcaatggtcataataaaatcatatgcacgaaccgaccaactaggaaaggatggattgttcagaccttgatggattaagatcaaaacaaatgtctctacggtaatgttatcatctagtagctagtaattggttatagaaacaatcgttacacaaatcatctactaaaattacaatagtaaaaaccatctttcaaccattgtcaaactaacaatgtattacacattcaaccggttactagtctatagatagtttttattattggttacatggtttgtagtttccataatgtaatcaaagttcgttattattttacctgattagtggtacccatcatgtgaccacacgatcttacatataaaagttaaagcaagtggagaaatcatatatcttgtgatccatgtgtgagaataatgatttatcggatatgagtcttatgtggtgtgcgagctagataagaaaatagtatatatgttttatgaaatgatccgcggtttacaggaccaaagagttctagctcgttcacctttttatttaactttaggctgaagacattaaaaaaaaaaaaaggttataatactactttgacctccattgaaaccaaaactatttgtctttccaaacagtctcccaaatgtacacccaacttcttcaaactcacccaatcttcactttcaaaccctgttcaatctcttccagccatccccttatcttcatcaacaccagtcaccaatttcccataaaccaaagacccccaaattcatcctttcattacaatcacaaaaccctgttcaaaactctcataaactgtactcaaaatgccgattctaatacaccaaaatgggaaaacttgttgccaaagaatgtaatctctgctgagaaaatattgaggtcaattgctggggcaacttctagtcctatttgtcagttcatctcttcacctactactttcttgcactctgttgaccccaggattaaattggtaaagtttgttgcttttttgaaaattcttgttattggtttttgggttttttctttattgataattttaagtctttaaccatattgtgatgtgatttaccttcttctttcatgttgagtgttgggctggtcagggggaatgggtcagttacccatttattctgatggtgtgcttttatgatttaagttgataaattccatgactttttaggggattcttgcaattcttcctgggtattgctttattgggtattttgtaaattggtttatatgctttagtatgtgttagttcaatttgttcattgttgttgaaaatatgttgtgaaacatagccatggctttgatggtcgtgcttttttgtataaaaagttgtttttatctttatgtaagaaaagatagagtgtcactagtagtctctgtgatggtagcttagttgccgggaaagttaagtttaatgcactttaggtggtgcggagttcacgctcttgcatttttttttatttttattttttgcattgtcttgcagtagaatttgcttatccttagggacctgattgggttgaaatactacttaagaaaagtaagtttatagtgatcagagcattatccaagtcagttcgattattacagaatttatagctaggggatgtct

SEQ ID NO: 13 - DNA, 8635 bp, Conyza canadensis
aaagatggggcttgaaaaggttcaaaattttagacctttccaaaattagataatttattatttttttctttttaagaattaagacatttaatttatttagaaagctataagtgttgaatcatcatgaaaattggcttataaaaatatgttaatattaatattatgaaccttcagaaagattttatgccataaatattttttatgtatgatgactgatgatattgtgtaaatatcatagattgaagaccctttcaaactttaaaaacggtgttgatatcatcactatttagaaaaagaactcttttttttttaatgtgatttatctcaaactttttatttaaatcgttaactacctgatcaacaggcggatttaagtacaactaatatcacacaaatgtccaattaaaaaatcatctcataatctatatggtccataacaaaagttgataacaacaaagttattaagcacctgaatatacttttgtaaaaggttagctagaaaaagacaatatatatcataccatcagacttctacttgtggaaataacgttaccaagcacatatttccatatgaattacaacatgctaacctatattaaattacgtctatgatcattaacccaactcgatttggtattgtgatgtggtgattataacttacaacaaagtacaatatgataaaacttgctttttttatattattattatatccaaagtctctatattaatcatatttaaaaaagctattgacaaatcataacaaacaacacatttaagttccatatatactatccatgaatcaatcaatgaatccaaaattttattttcatgatgataaaaaggaaaataagaagaaaaaaaaaatagtttgaggttgtgagaaaaagccttatctagtttctcatcatatatgttgagttgaggcaaggaatgaaagggagaggggggcttttgttttgttatgatgaccttaaaaagagaccaaaaaccaatttcctccacccacacccctatctctttaggaaaggccaatctcccctcctttgttttctccttttattttttatatatactttttattaaaataaaacatatactatttatttatttttacatccatttatcaaacaaacttgcaactttcttcttttcattcattttgccgctctcaaccatcacttttctctactttccggccggtacgttcctccctccctccctacattacgtcattgttttactcatcactatttacacacaaacatatgacttaatgtatacatataattttgtacggaacttttgcgatttatcagccgcacactcgaactaaattttttgatcggaaatgtagccattatatatatatatacacacagagagagatattaaatatatatatatatacacagagagatatcaaatatatgcatagcatatatatgcgtgtgtgtgtgtatgtatatataactttgctagtgttaattactcgaaatgacgatgtataacaagtagtagtaaatcagtagaaacggcgtcgtcctattagtgtatgatggcaactacaagtagtaaatcaagcctaaaagtttgttcaatattaaaaattaaaataaaaaccaggcctgaaaatgtggaagggttgttagtggttaaattagttgacctggatggaggtaggtcagatgataatagtagctgttgatccaggccaagtggaggatcaccacacacttgtatctactcttgattattttattatttttaaactgctacttttgattaatcattaatttcatatgaacattttaatataaacatttttgcatctgaaaatgtttttccatctgctaaggatgaaaggaccaaaatgcccttccatgctgttcaatgtttttcataatttaaaaggttatatatatatttattaatctagctagtgattatatatgttgccttttgaatctgatgatctttttttggccagctacttgaatattgttaaataaatttagaaaaataaatatatgaatgataagttttaacttttaggtaaaaggatcttgataagcaatagctgaaagtccggagctagaaagggcttggtattggtgggacgtaattgaaaagatatacaaaattaaacatttatgatttttgcatctgtttgtatttagtgtgtcgaatgaaaagtaaatgtataaagagttgtgataaatttttggatccgaactggtacagtggtacattacagacacgggcgaaagcttggagtgttactttgatcctagatcttaatagacgagattcgttacatattaactaataatagaaatgcagcaatgccccccttgtttatattaaagattcatttttctcatgtgtgaattatgattttttgataagacaaaagttgtttacttgaagttgaatgatgtgggttcctacttgttttaaaaatgtgtaacctcttatctaaaaactctgtacttacgatgatcacaagaacctgcattgctgaccatttatcttatttattgatatttttgtgtctgataatatgggtaggtgaaaatggcacaatgtttggctccttcagtacaatggcagatgaggttaacaaaaaatggtatggaatcaagctctatgtcatccaaaatgtggaactctttgtccttgaagcaaagcaagaaaggagcacttaagaacgccacaaaattcagcatctgtgcttcagcaaatggaaccattaacaggatggaagacctactaaacttggatgtcactccttacaccaataagatcattgctgaatacatttggtatatttcattctttggatacacttaccatacaaatttcaggcttactaacatattaacaaaagtttgttacgttactctaaaggcttgttcaattcttatttagtcctatgctttctactttctgaaacaggattggaggttctgggacagatgtgcgcagcaaatcaagggtatgttgggttttgatgctttggtttctttcagtaattatctatagcttcgctaaaaggaaagattgtaatatatgtttcattatatctcttgtagacactctcaaaaccagttgagcatccttctgagcttccaaaatggaactatgatggatcaagtactggacaagctccaggagaagatagtgaagttatcttatagtaagttttatttcaaaaaatcacaagtctctttacatgtggtgatgtaaccaaagttgaaattctgtatttcagcccccaggcaatctttaaggatcctttccgtggtggcaacaacatcttggtgagtataacgttggttcattatactataaagtcttatgtataagctgagaaactcccaccaaccaaaaggttgcagtttcgagttctatatggacaagtgcatgcgaattttttccccttgaaaaataaggatacaaactgaaattggacaacatatggcttaaactgattctgtactgtttttataggtgatctgtgacgcatacactccgcaaggcgagcctatccctactaacaaacgtgctaaggctgctgagattttcagtaatcctaaagttgtatcgcaagtgccctggtaggctttttgggtgaaaatgttcttttttttcccccatagaactaaactcttaaatccctgtgtttgataattgatacatacattaaacttcttgtcacatgaataaggggcagataggtctgactttattagtcaacatacacctcccttttatgtgaacggggatactctactaaaacaacaaaataaacaaatattgcctctgtttatttcccggtaaaattgattttaaatttggttttaggtttggaattgagcaagagtacactttgcttcagacagatgtgaagtggcctttgggttggcctgttggaggctaccctggtcctcaggtactattcatgatctaacttttgtaaacttctacaccttcctcatttataaatgggatttaatatcagttaaagctaaaggtggcaaaatgagtgggctagattgacctgaaagacttttttttaaactaattttttagttttccctatttataattagtgtgccaaatattgttataatcatttaatttcaaaaatagtttatctttttttgagtaaccattatactaaattcactcgtttgaaccattagagataaagcataactgaagagcgattctttcataagcaatgaatgaaattttccacccttaaaaacaagtgttcttattaaatgtatttccttttgaaactacagggtccatactactgtggtgctggagctgataagtcgtttggaagagatatatcggatgcacattacaaggcctgcctgtatgccggaattaacatcagtgggaccaatggagaagttatgcctggacaggttttttttctacttcttcaccttattatctaatgaattatgaaaagaagtatcatggcaacaattgtgtttcacagtgggaatttcaagttggtcctagtgtgggaattgaagctggagaccatatctggtgtgctagatacctccttgaggtaaatcatcttcagcaatttgatacagtaacaacttaatatatcctaccgtgtttttttaatctatatctaattgtttcttgtgactttactgtatttaacagagaattactgaacaagctggtgtcgtgttgacccttgaccctaagcctattgatgtaagatatatcttgtttgatgactactttccttcaattttccatcatagtgttcaaatcttgcttagggagaacatttgagcaacatgtaatgtcactcttttgtaattagaggtggttagataggcatgttggttaatgtgtccaaatgtacaattctttgatgacacaagcttagttgaccataaacacttttttccttttgtttttcttacaaaaaagacgaacaagataattggcaattcaagctatattaaaattcaaaaatttaaactttttgagtaaaaaggaatttcaggaggtgttatgagctaataaaagtatacattttaggtcactcatttgtgtcgatttcattttaagctacttctattgggtttaacaatgggaggcacagaaaacgcctcagttgaccctttgataactaaacgggttgaatttgccacctctacccgctctgaatgattctgattttattcttaacttacacaacgcttgttgatttgaattggcagggagactggaatggagcaggatgccacactaactacaggtacttgttttctttactcataatagacctgcgtattgtttttgaaacgctctaatgtgtgtgaacgttgatttctttcttatattaaaaatccattcacttacttttgtgctttcaaatttcagtacattggccatgagagaagaaggtgggtttgaagtaattaaaaaggcgattctgaacttgtcacttcgccacactgagcacatcagtgcttatggagaaggcaatgagagaagattgacagggaagcacgaaactgccagcattaaccagttttcatgggtataaaacattttatatcgaattataagagataaaccaaaaaaaataatttacactttcataagctttctcaactgatggtttttgtattcggtgaacttgcagggtgtagcaaatcgtggttgctcaatccgtgtggggcgtgacactgagagggaaggcaaaggtattgctatcttcacactacagtctttatcattggtggataattggatattggtaactcgtcaaactgggtaaatatatgttatggttcaacgtgttgggatgaccaaataaacattttatataattatcaaaatcttcataaacatattgttaatataccaaacatgtttccagaaattataaaatttcaacagtaatctgccttcttgaattaatcgatttaggaggtgtaatgcattagaatcacaaatcgccaactgattttatttttattttttctttctgaaataacctaaattgaccgttcattagtgagtctaaatttccacctttaaaaaaattctctttcgaaatctgttttttcacgggtcatgtttactatgtgcaggttatttggaagacagacgcccggcatcaaacatggacccgtacaccgtgaccggattactcgccgaaacaaccatcctttgggagcctacccttgaggctgaagcacttgctgcccagaagttggcattgaatgtgtaagactctcccacgaggtgatatacaacgaagaaagtgtcaacatgcatattcatccatgttcttcgtaaactcggtttcctgtttctagttgatttcttgaagatcttgtaaataaaggtcatcactgcttcaaattcaagctatttttagcaaatgggtgtttttcagatgattattggacagtttatgcacaatttgaagtgtgcacaagtgcacttgacccggtctgagcagacattattttctcttcttgatttaaagaaagcaccctcacattttgggggtattttctcttcatttgatcatatcatataattatcaatcggtttagatgggctgctgctccttttttggtcaattttattactagattgcttgtcaatgctaattatttcgttaaaattggaaaatgatgtaattcatacttacaattcttactgcgaaaagggaggctaaataacagtagaacactagaacttcaacaacaacgagagttataatacaagagagttaaataagcatttatataacttaactaagtaaaatatacaactatctcttttgccctccctgcttgaaaacaatggacttaatattgtggaatcacagtcaggaatctcaacgagttaaaaaaaatgacgatgatgtacgttaccattttttagttatacatcacaaacatgtgttctatcatacaatgatgtgaaacatgtatgtgttggtcaatggtcataataaaatcatatgcacgaaccgaccaactaggaaaggatggattgttcagaccttgatggattaagatcaaaacaaatgtctctacggtaatgttatcatctagtagctagtaattggttatagaaacaatcgttacacaaatcatctactaaaattacaatagtaaaaaccatctttcaaccattgtcaaactaacaatgtattacacattcaaccggttactagtctatagatagtttttattattggttacatggtttgtagtttccataatgtaatcaaagttcgttattattttacctgattagtggtacccatcatgtgaccacacgatcttacatataaaagttaaagcaagtggagaaaccatatatcttgtgatccatgtgtgagaataatgatttatcgaatattagtcttatgtggtgtgcgagctagataagaaaatagtatatatgttttatgaaatgatccgcggtttacaggaccaaagagttctagctcgttcacctttttatttaactttaggctgaagacattaaaaaaaaaaaaaggttataatactactttgacctccattgaaaccaaaactatttgtctttccaaacagtctcccaaatgtacacccaacttcttcaaactcacccaatcttcactttcaaaccctgttcaatctcttccagccatccccttatcttcatcaacaccagtcaccaatttcccataaaccaaagacccccaaattcatcctttcattacaatcacaaaaccctgttcaaaactctcataaactgtactcaaaatgccgattctaatacaccaaaatgggaaaacttgttgccaaagaatgtaatctctgctgagaaaatattgaggtcaattgctggggcaacttctagtcctatttgtcagttcatctcttcacctactactttcttgcactctgttgaccccaggattaaattggtaaagtttgttgcttttttgaaaattcttgttattggtttttgggttttttctttattgataattttaagtctttaaccatattgtgatgtgatttaccttcttctttcatgttgagtgttgggctggtcagggggaatgggtcagttacccatttattctgatggtgtgcttttatgatttaagttgataaattccatgactttttaggggattcttgcaattcttcctgggtattgctttattgggtattttgtaaattggtttatatgctttagtatgtgttagttcaatttgttcattgttgttgaaaatatgttgtgaaacatagccatggctttgatggtcgtgcttttttgtataaaaagttgtttttatctttatgtaagaaaagatagagtgtcactagtagtctctgtgatggtagcttagttgccgggaaagttaagtttaatgcactttaggtggtgcggagttcacgctcttgcatttttttttatttttattttttgcattgtcttgcagtagaatttgcttatccttagggacctgattgggttgaaatactacttaagaaaagtaagtttatagtgatcagagcattatccaagtcagttcgattattacagaatttatacctaggggatgtct

SEQ ID NO: 14 - DNA, 1550 bp, Euphorbia heterophylla
ctctctctatcccaaatttctgcaatacccacttccttttttcacccaaagctaggagtgggcgaaaatggcgcaaatcttggcaccatgtgcacagttacagatgagagtcccaaagaactcgacacctgcaagccccttatcaacaaagatgtggagctctctattcttaaagcagaacaagaaatcaacggctaggaacacttccaagcttagagtttatgccgtcaagtccgaaagtggcacaatcaataggctagaggaccttctaaatttggacattaccccttacaccgacaagatcattgccgagtatatttggattggaggaaccggtgtagatgtccgaagcaaatcaaggactatctcgaagccagttgaacatccatccgagcttccgaagtggaactacgatggatcgagtaccggacaagcgccaggcgaggatagtgaagttattctatatcctcaggctatctttaaggacccattccgagggggtaacaatatcttggtcatttgtgatgcatatactccagctggcgagccaatcccaaccaataagcgccatcgagctgccgaaattttcagtaaccagaaggttattgatgaagtaccatggtatgggatcgagcaagagtacaccttgcttcaaacaaatgtgaattggcctttgggttggccagttggaggctatcctggtcctcagggtccttactattgtgcagctggggcggataagtcatttggccgtgacatatcggacgctcattataaggcttgtttatatgccggaattaacattagtggcaccaatggggaggttatgcctggccagtgggagtatcaagtcggtccaagtgtgggaattgaggctggcgatcacatttggtgttcaagatacattcttgagagaatcaccgaacaagctggagttgttctcacattggaccccaagccgatcgagggtgattggaatggtgctgggtgtcacactaattacagtacaaaaagtatgagagaagaaggtggatttgaagtgataaagaaagcgattttgaacctctcacttcgccataaggatcacattagtgcctatggtgaaggaaatgagagaaggttgaccggaaaacacgaaaccgccagcattgactcgttttcttggggagtggcaaatcgtggatgctcgattcgagtaggtcgtgatactgagaagaatggcaaaggttacttggaagacagaagacccgcgtcgaacatggacccttatgtggtgacctcgttactagccgagactacgcttttatgggagccaactttggaggctgaagctcttgcagctcaaaaattatccttgaaagtataatcgactcggttcgagaaattctcgagctttcgggaattagtaatttcgttaaagttcgcgtctttgggaaaaatcatttgtaaataaaggttccgatgcgagtaatttctttttcttgtaaaatggtctataactgatgtttgacatcaaaaggaccactttttttttttactttttactttat

SEQ ID NO: 15 - DNA, 3777 bp, Euphorbia heterophylla
aaaaatatttgcactattaaagtttcaaatttttttatgacttttatttcatatgtgattatgcttgttctgcttcgtaaaatgtcgactttttcgttgtcacacagtgggagtatcaagtcggtccaagtgtgggaattgaggctggcgatcacatttggtgttcaagatacattcttgaggtattattaattttattttaccgagtctcatctatcaagtcggtccaagtttgtgaattaatttcgaagaaaggcggtctatgttttagtttcggataaataccgtttcaataatcaccttttatgacagagaatcaccgaacaagctggagttgttctcacactggaccccaagccgatcgaggtgattccgactcacatcttcatattgctttttcttgttttagaaaataaaaaaaatcaacttaaatcgaacttgtttttcgatagggtgattggaatggtgctgggtgtcacactaattacaggtaacttaatgttaatcgatctcgattttgaactcttttttagtttttccatcgaaaataacaagaaatttcgatttttttaaacccgtatctttcagtacaaaaagtatgagagaagaaggtggatttgaagtgataaagaaagcgattttgaacctctcacttcgccataaggatcacattagtgcctatggtgaaggaaatgagagaaggttgaccggaaaacacgaaaccgccagcattgactcgttttcttgggtaagcctaaaaacgaaactttatccgaaacaaataaaaagacgacgacttttcgtagctaatttggttctaatcatgattcatcgaaatttgattttagggagtggcaaatcgtggatgctcgattcgagtaggtcgtgatactgagaagaacggcaaaggtattctatcttaggggtgagcaaatgtcagtttgaaaaccgaaccgaaaaccgaatagagaaaaggagtgaaccgaatacagaaccaaattaatttcggttcagttcaaactgaaccgaattatttcggttcgattcgttttggttttgaaccaaataaatttttcgttaactttatatttttaaatatacatttaaatatataaaatgacaaaaaaatcaacatagttatctttgaacacaaatacattattgttaatttgaaaagaataactttattttcaagtataaaatgtaaattgaactaaaaacataaataaattaaacatgaaaaaaataaaaaaaatccaattcggttcggttttcggttttttcaggttatgaccataaaaaccgaaccgaataagttcggttcggtttcttggtttggttcggtttccgatttttttgctctcccctagtctatctcgaggaaatttgattgaatttctcaaatggaaattctcgatattttgctgacctggcgcgtaattcttcggttttttaggttacttggaagacagaagacccgcgtcgaacatggacccttatgtggtgacctcgttactagccgagactacgcttttatgggagccaactttggaggctgaagctcttgcagcccaaaaattatccttgaaagtataatcgactcggttcgagaaattctcgagctttcgggaattagtaatttcgttaaagttcgcgtctttgggaaaaatcatttgtaaataaaggttccgatgcgagtaatttctttttcttgtaaaatggtctataactgatgtttgacatcaaaaggaccactttttttttttttttttacttttgactagtcgagaacccgagtaattttttgttgtttgaagcatcggcgcctttgactatgatttgattatataacatttctgttcttgatttaattgcatttaaaatataataattcgaggcctctcggaagtttggaaatcaggttttcggtataaacccaggaagccgaaaaagcttgtggcacactaaaggagagataaagtgaacaaagataaaattacaggtattagtataactttattccatttgtctgcaaaagacgaaaacttgtaaactatgcaagaatcaatttcgattctttgccctcaaaagaccgaaacatttctttcgttttaagatagtatgttctaaaacaaaaaatattcgttaaaaaaactctgctttgcatttatataactctactctaacctcagcaaaggccaaaaaggcaaaaaaacattgaaatttctcggctttccaaggcgaaaaaaccgatcaaatggcatccggatcatcgaaatcggtagccttattgctttcgatagtcaacattgccctctacttcatcattatagtaattgcttcatgggctataaacaaagcaattcaccgaactcacgaaaccggtaaatattttaattttaagttaattctaaatttaatttagttttactatactaatcataattttttaattcagtttcggttttgtcaatcccggctcgaattttccccatattttttccgatgggaaatatggcaaccgggtttttcatcatatattccctactcgccggagttgtgggaatcgcttcctcactcaccggaattcaaaatttatcgaaaccgagtgtctcgagtctacatgccgctgcggcgatttctatgactgccctttcacttactttactagccatggggtagtttttgaaaaattcgttacttatttatgcttatttgtgtttcctatgaacataaagttttgaacttttttttttcgggattttgtttcgtagactggcgtgtaaggaaatacaacagggttggaccgattcgaacctgaggactttggagattgtgacaatagttgtgagtggtacgcaattggtgagcaccggtgctatattttctgggattaattgaagatgttgcgttagaagaaaaccgagccgtgtggattgggagggtagctcgaaaagtttttcgaaactcggatttgaatttcgatttattctaactggagttttcaagtacaaatgtatgtttgcgagttcagtttgaagtctttaagcatttgtttgaatttgcatgttggttgtgtaatttagttaatatttttacaatgttaataatgaacctagctatttcatatattctcttgacatggttaagagtataaatatgaatatatatttatatatgaatatgaacctagttatgtagttaagaatttatatatattttataaacaaaacatttcaagttgttattatataaacctaacaacaaaaaaaagtaatagttaaattataatgataatattattaatatatactactttataaagctaactcgattacatttttaatcaaaatttcgtattatatgaaattaaatatttaagacatattttaactaatccgtagcattattatttctctttcaaatcgaattattagttgaataaaaggaaaatttataatttatgattaaaatcaaactatttaaatacaaaagatcagacgatttttctcgaatgtataccttaattgcaattttattagaattgaattggaccgaccaattgcactgatttgatttacggttgaactcgattttacaaataaaattataaactattatcttaatgtctagtccaatttcaataacatttgaactgaatttttcaagccgaatttatggttaaatttaaatcttataaattctaattaattacatgtataaaaggtaaattccaattttaaacaaataaaaaaaaaacctttttccgaggtaatc

SEQ ID NO: 16 - DNA, 1755 bp, Euphorbia heterophylla
tttatgccgttaagtcagaaagtggcacaatcaataggctagaggaccttctaaatttggacattaccccttacaccgacaagatcatcgccgaatatatttggtacattttttttcgccctttttaatcttttaccgaaatgttcgtcatattttgtattatcacatattgataatcacattttgaattaggattggaggaaccggtgtagatgttcgaagcaagtcaagggtaattcggcattttgaatatttcggcgaatcgataagtttatttatttgtacggtttttgatttattgttgacttttcgtgtttttcagacaatctcgaagccagttgaacatccatccgagcttccgaagtggaactacgatggatcgagtaccggacaagcacctggcgaggatagtgaagttattctatagtaagatcacgcaaaaaaaactctttgcaatttattcttatttacgataagcatagttttgactttatgttttttccagtcctcaggctatctttaaggacccattccgtgggggcaacaatatcttggtaagtttttctatcaaatagctagcaaattggtcctgaaatttagtccatattttgtttgcgtggctaaattttttgggctttttctaaaatcccaagatttttagattttttttataaagtatatcctaaacataatttattctaaaaatacaagattttaaattttaaattttgagaataccttctttttggtcataatagattttatacctttttatatcttgatttatgtatattataccttcaattaaaatataccgtataagtcaattaccaaagctaaaaaaataaaatcattataaaatgcaaaataaaatcggtataatatcgaagttagaaaaaacatcaaaaccattacaaagaacagaatcaaagaatataatacatattataccagatattagaaaaggtgtaatacatattatacgcaattataaaaaggtataatatctataataccaaaaatcttgtatttttagaataaaatattatttaagatatttttttgcaaaaaaaatctaaaaatcttgtgtttgttacaatttcccaaatttttttcgttattgtgtgaaggtcatttgtgacgcatataccccagctggcgagccaatcccaaccaataagcgccatcgagctgccgaaattttcagtaaccagaaggttattgatgaagtaccatggtaaaaactcttcagttactttttttatttccgggtttttactgtttgaccaaaagattcgatttttaatcatttgaaaaggtatgggatcgagcaagagtacaccttgcttcaaacaaatgtgaattggcctttgggttggccagttggaggctatcctggtcctcaggtaaaattgtttatgagctctaagttaagttccttatcggtttttttttcgaacttgggcagttaaattacgtttgggtccttttttcagggtccttactattgtgcagctggggcggataagtcttttggccgtgacatatcggacgctcattataaggcttgtttatatgccggaattaacattagtggcaccaatggggaggttatgcctggccaggtacactttttttcagggttttatttttttaacaattcaacattctaataatttaaccttattattgaaaaattatgcgtcttgatttgagtaattttcggagattttttttattttttaaagtttgtta

SEQ ID NO: 17 - DNA, 1587 bp, Commelina diffusa
tttttaagctccttcaaatcatccattcccacattgccatttccatttcctcaatctcttgaaatgatggctcaaatgatggcaagtcctatgcattgccagatgcggcttccgggcaaatccatgagttccaagcctttactggattcgaaaatgtggagctctctgctgctcaactcccagaagagcaagaccaagaggaggaccatcaacttcagggtgagcgcaaagttcgagaatggcgttgtgccgaggatggaagatcttctcaatttggacactagcccctacactgacaaaatcatagcagaatatatttggattggagggacaggcatcgaccttcgaagcaaatcaaggacgatatcgaagcctgtggagcacccgtcagagctgcccaagtggaactacgacgggtcgagcactgggcaggccccaggagaagacagtgaagtcatcttatatcctcaggctatatttaaagacccatttcgcggaggaaaccacattttggtgatctgcgacacgtatacgccggccggggagccaataccgacaaacaagaggcacagggctgcccagatattcagcgacaagaaggtcgtcgacgaagtaccatggttcggtattgagcaggagtacaccttgctccagacaaatgtgaactggcctcttggatggcccgtcggagggtaccccgggccccagggcccctactactgtgctgttggcgcggacaagtccttcgggagggacatctcggatgctcactacaaggcctgcctttacgccggcatcaacataagtggcactaacggagaagttatgcctggtcagtgggagttccaagtcgggccgagtgttggaattgaagcaggagatcacatatggtgtgcaagataccttcttgagagaatcaccgagcaagcgggcgttgttctctcagttgacccaaagccgattgagggtgactggaatggcgcgggttgtcacactaactacagcacaaagagcatgagggaagagggcggcttcgaggtaataaagaaggcaattctgaacctttctcttcggcacaaggagcacataagcgcatacggagaggggaatgagcgaaggttgacaggcaaacacgagacagccagcattaacactttctcttggggagttgcaaaccgtggttgctccattcgtgtgggacgggacacagagaaagaaggcaaaggatatttggaagatcgccgcccggcgtcaaacatggacccatatgttgttactgccttgctagcagaaaccactcttctttgggagccaacactagaagctgaggctttagctgcccagaagttggcactgcaggtgtgagatggtggccatgaagttgaggtctagccatgaaatgttaatgtccaaagaattcaatcgttcactgaattcagcctctcctgaatgtttgttgtcatcttacattaattcctcttgatttttatgttgttggagctgtttttttcttgtggtaatgttcagtttctccatcacaaggagtatggcactagagagaatataattatcaataattatatttat

SEQ ID NO: 18 - DNA, 6900 bp, Commelina diffusa
ttgtttcagtattaaatttagaacaaatatttttagcttagggttagttcttgaacttatttagaatgctcgcaaaagtgtagtataatgtgaaggtatactttgttctagaacaatatttcttaagcttagcattagtccatgtatttaatttcagaatattagcaatagtatgtagtataatgtgaaggtgtactttgttttagaacaataatttttagcttggcaataatttcataatactagcaaaaatatagtataatttttagcttggcactaatttcaaaagtatagcaaaagtatagtataatttttagcttagcataagaccactttaattttaagttattcgcagaaaatacgtaaaatgtaaagtaaggcatactttgtttcagtattaaatttagaacaatattttgtagcttagtattattccttgaacttaatatcagaatctttgcaaaatgtatgtataatgtgtaggcatactttgtttcaacattaaatttagaacaatacttctttagcttagcattatccctaaacttgattttcagaatactcataaaacttatataatgtgaattaaggtatactttgtttcagtgttgcctgaacttaattttagaacattcgaaaaagtataatataatgtgaaggcatactttatttcaatgttaaatttagaacactatttttcagctcagagaacattcacaaaagtacaatataatttcaacgggcatactttgtttcagtatcaaatttagtttcaatttgtgttcttatcaagtttttgtgctaaaaaataggattggagggacaggcatcgaccttcgaagcaaatcaagggtaagtacacagttaaaacctgcaaaaagtaatgtccaaatggtggttctgctgtatcttttgtaagtgtttcgattgtgtttcagacgatatcgaagcctgtggagcacccgtcagagctgcccaagtggaactacgacgggtcgagcactgggcaggccccaggagaagacagtgaagtcatcttatagtaagatatctgcgccattaccattttatcttatagtaagatatctgcgccgttaccattttaataagtaactgtaactgctcgcgctttgcagtcctcaggctatatttaaagacccatttcgcggaggaaaccacattttggtatgcatttcattataaacattacactaatctattcttgagttatctgtaactcaaagggtctaaatattgagtccagactactgtcgttcttcaactaatgaacaactaattcaggtgatctgcgacacgtatacgccggccggggagccaataccgacaaacaagaggcacagggctgcccagatattcagcgacaagaaggtcgtcgacgaagtaccatggtaagtcctggcctcagcagttttagttgagtacatggtttaatattgtccctactaaaatttattttttgatgacaaatccgaaaccttcaggttcggtattgagcaggagtacaccttgctccagacaaatgtgaactggcctcttggatggcccgtcggagggtaccccgggccccaggtaacatttttttctgttacttagtaattacaacactagtcatttggtaacgcagtttggctgtcaccaaagcctgtgtctgtgagattttattacaattcagcacctttacagcttcagaccgttgagacaatctcctcaatttgtagccaaaacttgagagaaaaccaaagctataaattgacaaatttagtccataagacctatcatacacctatatatagcctagcatcccagctgtaaaaaatgtctcgctccaagcagcctacaacactacaacttggaacttgcaaaactttagaatcccagttagatacattatcgacaacagggttgcaaccagtcagcaattccagcagaattccagtagctttatcgcaccagcttccaagttttttccaccgtctttgcaacttctatgtgaaacaaaatgtcgacacaaagactaacaatcaaattccgaagctgaacattcacagttactgtcacattttatgtcgtcgaaatgttatttctcttagtacctgaaatgttagctgaattcaagaaatgtaaagatcaacgtggagtctaggaaatgttattcctattagttcttatcaaaatattgaatactttcagggcccctactactgtgctgttggcgcggacaagtccttcgggagggacatctcggatgctcactacaaggcctgcctttacgccggcatcaacataagtggcactaacggagaagttatgcctggtcaggtgcggaattcatttcatttcagctcattttgatttgaacatacccgaaaaaataaattcctgaaattttattcaaatctgaacatgaccaacattagggcacgccattgtacttctcacaagcttctcggattttatctgtagtgcttggaaatgctgctaaaatctttgactttctcttactgtctataaaaatatgttgatagtttgggaatttcagataagtactattttagctgtgaaattaaaatacagtgtactgaccaatcgatggattctgtagtgggagttccaagtcgggccgagtgttggaattgaagcaggagatcacatatggtgtgcaagataccttcttgaggtaatttgggaacatttttcttagttttataaaattaagagtcgaaaaaaccatacattataacttatacggttgaactcagactcaaactcgattgacatttttttttagtcttcaaagatgttcccaaaattcggaagaaaaagtaataattaagagaacatacttgcaacgtacctaaaggcacaaagtttttccctttttgcgatatctgactaattctttgcattacatgtattaactatttcaaaattactcagagaatcaccgagcaagcgggcgttgttctctcagttgacccaaagccgattgaggtacttctaaaggcagttgcagaaagcctgaaagaaaaaagcattatcgtgaataacttcttctaaagactcaaaaaatttattttattttatttttgtttagggtgactggaatggcgcgggttgtcacactaactacaggtgactgaaaaaacacacatttatttatttatttatttatttattttgacgatactgaatgaagaactaagtcagaatatgtgactaattaacgtgtagcacaaagagcatgagggaagagggcggcttcgaggtaataaagaaggcaattctgaacctttctcttcggcacaaggagcacataagcgcatacggagaggggaatgagcgaaggttgacaggcaaacacgagacagccagcattaacactttctcttgggtacagacaagcatttccctgaaatttactcaactgttgtgaatttttttttgggttgaaattttgatatgttttgtgtttaaagggagttgcaaaccgtggttgctccattcgtgtgggacgggacacagagaaagaaggcaaaggtatggagcttaaattacgagattaagtattgttttacatagaagcttcagacgagctcaaaaaatggctttaagctcattcacattgctatattaattttttaaaaagaaggaaatcttagattacgagattaggtagtgtcatatacagaagcttcaatggagctcaataatggttttaagcgcgcattcatacatgctagattcagtattgaaatggtttatttattttgctatagaatttttagaggagttcaaaaatgattataagtgtacattcacagatgctaggttttgtattgaaatgattattttttttttaatagaagctttagaggaactaagaaatagtttaagcacgcatccacgtgctagattgaaatgattatttctttaactacaaaagcttcagatgaattagagatgacaatcaagtgtcgcattcactatattcacatatgctagattttttgtattgaaatgattatttctttcactatagaagcttcaggagctaaaaaatggttttaagcacagactcgctatattctgtactgaaattatttctttcatcgtagaagcttcggaggaacttaaaaatgactttaagtgtgcattcacacatctagatttatattgaaatgattatttctttcactatagaagcttcagacgagcttaaaaatcttaagcacatatgctagattttgtatcgaaatgattatatctttcgctatagaagatttagatgagctcaaaaatggcattgagcgggcactcacatatgctagattctatattgaaatgatttattctttcactatatatagaagttttagatgaactcagatatgactttaagcatgcattcttacatgataaattctatattgaaatgattatttctttcactataaatagaagctttagttgaactcacatatgctagattctgtattgaaatgattatttctttcaccatatatagaatctttagagaaattcaacaataacttttgagtgtgcattcacatattctttattcaaatgattatttcattcgctatagaaactttacatgagctccaaaatgttttttaagtgcgcaatcacatatgctagattctgtattgaaatgatgatttctttcactatatatagaagctttagataaactaaaaaatgattttaactacacagtcacatttgctagattctgtattgaaatgattttttcttccattatatatagaagctttagatgaactaaaaaatgattcaaagttaacattacatatgctagattctgtattgaaatgattatgtctttcactatatagagaagctttagatgaactccaaactggctttaaacgcacattcacagatgctagatcctatattggaatgattatttcttcactacatatagaagcttgagatgaactaaaaaatgatttaaagtgcacattcacatatgctagatcctatattgaaatgattatttcttcactaaatatagaagcttgagatgaactaaaaaatgatttaaagtgcacattcacacatgctagattttgtattgaaatgattatttctttcattccatataaaagctttctccaatggctttaaattctcattcacatatgctagatcctatattgaaatgattatttcttcactacatatagaagcttgagatgaactaaataatgattcaaagtgcacattcacacgctagattttgtattgaaatgattattgctttcactacatatagaagctttagatgaactaaaaattaacttagtgcacattcacatatgttagatcttatatcgaaataattaattttcaactacagaagcttcagaagagctcaaaaaatggctttaagtgcttattcatacatttttactaccttctatattgaaatgattatttctttcactatagtatgacactcatttacacaattacaccacaaatacaggatatttggaagatcgccgcccggcgtcaaacatggacccatatgttgttactgccttgctagcagaaaccactcttctttgggagccaacactagaagctgaggctttagctgcccagaagttggcactgcaggtgtgagatggtggccatgaagttgaggtctagccatgaaatgttaatgtccaaagaattcaatcgttcactgaattcagcctctcctgaatgtttgttgtcatcttacattaattcctcttgatttttatgttgttggagctgtttttttcttgtggtaatgttcagtttctccatcacaaggagtatggcactagagagaatataattatcaataattatatttatgaaatggactgtatttatttttatatattaacgggatggataacttgaaacaagtatttgtgtttatgctctgggtgttgattgactagtattaatactagcaatcataactcctaacagagctgcgaaactttgaacccggaacctcctggagagataagatgcggtggtttgcgaaatgaaatgcaatggttgttgggttgaggcatatgtatggaagtcatgcatatgatgctttgtgtcagggttgcaagtattggtttttgggataggtataggttctaaataatccaatgcataacaatatcaatagctatccacatcagatttgttattagatacaatgaaacaaataatatggacaaaaaataagttttaaatggaatttttttttcttatatggtttcggctcaaactaactaaaattacacgaatacgaccaattttgccttatctattatcaaaatcgactcatcgaccaacttaaaaaattgaaccaataatttgtaggggcgaatggcccgaggggcatatttgactcgcatcaggggaagttttacaaccgaacataaacaaacgccattgcaacaaaggatattatgagaaaccgtggtatgttggtgggcgcaacttatgtgtcatgtggcggggatgaaactgcttcccacctgttgatgttcggtattcaagccttacctaatgtgagtctgacttagcttggttattcggttcggcccagatgtgggttcaagggggagtacctccggtccaatttggtccttctcttaaggtcgggagtcacctgcaagacccgtggatgttgccctcggggtagagcctctaacgctcaagtcagttatttggtccctaaaagagtgcacgagagagagagagagatacctgtggagatatggagtatttatagctcctgtcacgtcaacatcgcatcagtacggctccacgtggcgagctcgatcgttcggc

SEQ ID NO: 19 - DNA, 1535 bp, Digitaria sanguinalis
ccttcacttcaaccaccactctccggccacttttccggcccctctccgtcactcctccggtgaaaatggcacaatgtttggctccttcagtgcaatggcagatgagggtaacaaagaacgcgatggaaccaaactctatgacatccaaaatgtttaactcttttgctttgaagccaagcaagaaaggagccatgaaaacctccacaaaatttagaatatgcgcttcagcaagtggaacgattaacaggatggaagacctgctaaatttggatgtgactccttacactgacaagatcattgctgaatacatttggattggaggttctgggacagacgttcgcagcaaatcgaggacaatctctaaaccagttgagcatgcttctgagcttccaaagtggaactatgatggatcaagtactggacaagcacccggcgaagacagtgaagttatcttatacccccaggcaatctttaaggatcctttccgtggtggaaacaacattttggtgatctgtgatgcatatacgccacaaggcgagcctatcccaacaaacaaacgtgctaaggctgctgagattttcagtgatcctaaagttgtagaacaggttccctggtttggaattgagcaagagtacactttgcttcaaccaaatgtgaagtggcctttgggttggccagttggaggctaccctggtcctcagggtccatactactgtggtgctggagcggataagtcctttggaagagacatttcagatgcacattacaaggcttgcttatatgctggaattaacatcagtggaaccaacggagaagttatgcctggacagtgggaattccaagttggtcctagtgtgggaattgaagcaggagaccatatctggtgtgctagatacctccttgagagaattactgagcaagccggtgttgtcctgacacttgaccctaagccaattgagggagactggaatggagcaggatgccacactaactacagtacaaaagccatgagagaagaaggtggatttgaggtaatcaaaaaggcgattctaaacctttcacttcgccacactgaacacatcagtgcttacggagaaggaaatgaaagaagattgacagggaaacatgaaactgccagcatcaaccaattttcatggggagtagctaatcgtggttgctcaatccgtgtggggcgtgacactgagaaagccggcaaaggttacttggaagacaggcgcccggcatcaaacatggacccatatacagtgacaggattacttgcagaaaccaccatcctgtgggagcccacacttgaggctgaagccctcgcagctcagaagttggcattgaatgtctagggccgatccatgttctttgaaaattcggatttctgtttctagtttgatttcttcgacgtcttgtaaataaaggtcccaaaaagtcatcatatttaaagctttttgtagcaactgggtggttttttatgagacgattattggacagcttatgcacattttgatgtgtgtataagtaca

SEQ ID NO: 20 - DNA, 7358 bp, Digitaria sanguinalis
gaaggggaaaatgcctcatcatttcccttggaaagagagggtgtctaactttagcaagtgcatatgcggaatcggcaattaatactacagttgagattcatggaatcaaagatggaaagatacagaaatattcatttcaccacatgcgtggctgtaatgaataaccaaccaggtatttctgtactgtcactaatgtgctggcattgcagcaggacaaacctttcctcctttttcgtacggtgcatcacgtgccatgggttcataatctctagatcatgctcagagagactttctttttcttgcggaacaaaatatttgcacgcacgaaacaaaattagatggaccaactattattttgtgcgtaacatcttatagatatataggaacggtccaaataatacaatacaatatcttatatagatatatgtgaaaatcaaaacaatatccttatggatattgacatattgtggaaaaatccaaacaactccacataatgtgacatgcatattgtatgaaaaatccaaactacaccatgatacacctcaaggatgttgtgggaataattcaaacaacacgatagaacatcttctagatattgtagaagccatgcaaacaatacatgcaacatcttatagatattatgcgaaaataccaacaacactatggaatatctcttagatattgtagtaacaatccaaataacacaataaaatattttgtggatataacgaacaatacaaaaacataatgaaacatctcacaaataatatatgaacaatcaaaatgacaccaccaaacatctcgtagataccatggaacatctcgtggatgttgcgaaaactgtcttaagaaatattgtgatatatattatgagacaattttttagaaaaaacatcatgaaatatgaggcaatccaagtaataccagagaaaatatcatattatagtaggaacaatctaatcaaatatcatacaaataatataaataacaccataaaatatctaatgaattatataaaaacagaacgcaggcacggagcaatgaaagcacagggcaatttccagcccttgtgccgatgaggtggctttaggtacgagcgtgattgaataaaaaaaacattttaaaaataatttcggctcctttttgggctatccccagacatgggaaaagttttcaaatttcttttacccctccctctgtgctcggaactcataatcaaatcaaccacttccggagataaagctgcctgtgcgcaattcaatattttcccacaccaactactgcacgtcctgatccacgtctcactgacaggctgcccccaattggttggtcccgcttgtcagcgacgaggctgagcgatctcctggtacgggatggtcctacttgtcagcgacgaggtgagcgatcttctgtacggggtggtccctccccgcacctaccgcgtcgaagaaataatcgaatagaatatacgcggaactcgaaaggtaagattttgcagcggtatttgtacgtgtatggcgtatagtatacgtattttgttgggatcaagggctggaagcttgacgccaacttgtttccatcccttgggtcgtcgccattatatagccgccctcctctccaccgatctctaatccagcaccacatcctcctcttcttcctccgcctcccaagcctgcccgtgccaccgccagccgccggccatggcctgcctcaccgacctcgtcaacctcaacctctccgacaccaccgagaagatcatcgccgagtacatatggtacgtcacgtctcctactccttgttaagcgtccgtcagagagaatcgatcttgctggccgccggctgcctttcatggcgtctcggcggccggaaacgggctctggtcgaccgtcgcgtgtaaacgaaagatctttgggggcgtttggggagggtttttgggggagacggaggtttctcgtagattgttgcggatttgcctcccttttcgtcttcaccggctgaagcggcggcggtattagttccccccttctcctctgccagacaccagagcctgccaccctgtgcaacttctctgttttctcttggtggtgatcaattaattggttgtctgctcaatcttcatgtaaaaaaaaaatcaaactgttttttcttttatttttttgccggtttattctcccatgaatatttgacttcagttggggatatgcttcaagagagatgcagtcgaaactcgaagtacttgatgtacgtctcttgttcctcctgttgggggaggatatctgaagcggcagtcgctgctggccaactggttggtccctcacgacaccgcgacggccagatgatctgttggcacagtaatcctatgtttatgtgttaatttatccccctgatgccctcaaatagattgctcttctccgatgaacatggcgtggagttgttcggtttgttggtgatttgaccctatcttaatgcatggctccttttctgttacaggatcggtggatctggcatggatctcaggagcaaggccagggtaagatgataaagattcccacgcttggactggaatactgtttgctgtgactcatcacttatctctgaagtcatcctctgagctgttctttggcttatatatcggatctcagctggctgccatgctgctttcctttttattttttcttaaaactagaaagatcttttttaaacattaaaattcatatcgatctggttggtgcttcgcagaccctccccgggccggtgaccgatcccagcaagctgcctaagtggaactacgatggctccagtaccggccaggcccccggtgaggacagtgaggtcatcctgtagtaagtatcatggcatgccatcccttcgcttttgttctattgctagcaaaaaaggaatgatccttatctcttgtgcatgtgccatcctgcagcccgcaggctatcttcaaggacccattcaggaagggcaacaacatccttgtgagtttccacttttaacatccaagggatctgaatcatatgttactattgtcatacagctacagttaaattgatacaactcaatcagtccacccctgtgaaaaaagtttgtcttgttactaattacagtaggtataaattatgtttttagtttttaatctgcctgctgtataggtcaaattatggtaatgcagcactaaagattcctaatgcaggttctcaactctgaatctctgtctagttagcagaattgcaaattatataacatgctgacctggtgacatgagcttagatattttttgaactaaaagtctgattgtccagtgtacctaaccataggtttaggaatctgatcggttgttttgtcaacctctaataatagggaccatttttgggcattcaatgaattcgtttgacccgcaggtcatgtgcgattgctacaccccagctggtgagccaattcccaccaacaagaggcacaatgctgccaagatcttcagcagccctgaggtcgctgctgaggagccctggtacgcaaatctttactgaataactatgataaaaggcgaaacaatcaatatatttacaaaattgaccatgattgttttgccaatggcaggtatggtattgagcaggagtacaccctcctccagaaggacatcaactggccccttgggtggcctgttggtggcttccctggccctcaggtagacgatcacttcattagttggcttgcttaagattttattcattgattcggtcctacattggttggagtgtcccttgacagatttcaattatcttttagggtccttactactgtagtattggtgcggacaagtcgtttgggcgtgacatagttgactcccactacaaggcttgcctgtatgctggcatcaacatcagtggcatcaacggggaggtcatgccaggacaggtgaaattttactagacttggcaacctgttttgtaccctgaagttaacatctttctgaccatggtaaaaatgctgtggttggtttcagtgggagttccaagttggcccgtccgttggcatttctgccggtgaccaggtgtgggttgctcgctacattcttgaggtatggatccaacttctggaatctatatgtgatcaaatataacacgatcttcttgaaccaaacaagatttgcagcacttgagctaatctgtccctttttcaacagaggatcactgagatcgccggtgtggttgtgtcattcgaccccaagcccatcccgggagactggaacggtgctggtgctcacaccaactacagcaccaagtccatgaggaacgatggcgggtacgaggtgatcaagtccgcgatcgagaagctgaagctgcgccacaaggagcacatcgccgcctatggcgagggcaacgagcgccggctgaccggcaggcacgagaccgccgacatcaacaccttcagctgggtacgtcgtcccccattgtggacttggattccccaatccgtggaaagggagattcgtgtgccaactctgtttgttctgtctcttgcagggagtcgccaaccgtggcgcgtctgtgcgcgtgggcagggagacggagcagaatggcaagggctacttcgaggaccgccggccggcgtccaacatggacccctacgtggtgacctccatgatcgccgagaccaccatcgtctggaagccctgattcgtcccctctccagctccccgtctcgtgtcaactgcttctgcttcgggcggtggcggccatggctactacctctggcgattgcgttgaactgggcacaacaaatgtccgatgattccgttccattccgtctggttatactattggcatttagttagatccatgtcgagggttgtgcgaaaacaaaacagaacaaaaaccattgtttgctttgatgctttccacttcccatgccttccgtttgggtggtcacttgtgtaatcctccaataatgaccgtaccgcagcggtggtaccttcagtacttgcatcactagtgctagccctctttttttttttctacatgtgcattgtgagtgacagtgagtgggtgggtgtaaattgtatcacaaaagtggcttgctttgctgcacctccaatggcaatggctttcttccggcgataaagaatcaatcatcatggctgtggcgagtgcgggcagtgcgtggccgcactgtggtcgccgattaaagtaatcctgttttaggtcagattcttgaacgggttacttgtcttttctccgaaaattcagcaccaccggccattgatcactcaggaatcttgatcggttggtggagggagggtcacggaagagctgaatgcttgtcatcttgcacggacggacaagtggggggcacgagaatccatcagagatcacacaacaacttcccagttagttccatgacgtatgggcccgctgctctgtggaccccgtatcccatctttgcagcgagtatgggcccgctgctctgtggaccccgtatcccatctttgcagcgagaccgcgtcccgtgcagttagcgctgcaacagccaacgcgcgtcagctccagccctagccggcaccagcccagccaaccgaatcttcctctcatcacacagacacagcaactactagatgttgctatccaatgactgttccacaacatggcccctcttctctcagttcgactggtccgatcggatcatctggtggagcagtactagcagcttgcagcgccagcaatccagcatgttatcgtctcgagctctcaacaacccaactactctcaaaaagagaggatggcccggccggcgttcttgacgacgctgatttacaaagttgacccgcgggcacaagcacttttacacagcatcctcaccaactccggcgacattgtacgggcacatcttaaccgctcggcttgaaacggcgatgccatatgttttcttttctcgctaatccctgccaggtcaaagcttgacagtatctgggctacccacggcacactgaaagcctgaaacatccagtatcttcatcctcgcacgtctcgccgccgggctttctttatgagaaaatccagcgtctctactcccaactacaattttgttcgttgccgagtcaaagcataccgtgcaggttggttccagtagaacagtggcccaaaggcacggctaaggtcagccatccttttgcggctggaaagggctgattggccggcactatctgtcacccacggaaggatggacggagaaggaaacacatcagcaggccgaggcgccacttcgtgctaccaaaagctactcgtggctctctgtcttgtagccatggattacaggattagagctctgatttcagcgtaaacaactctgtttccaaggaaagcattgtttagtacaatggcagcaaactgcggccctgatggtgagagaaactccggcggaagcgacagaaacatggtgcaagctaatcagatgcttcagataggtataattatccatgacactgccagatgttgctcgatttcaatttcttttaggaagaatgttcaatacacctatattctgctgctgctgctgatctgggcaagaaacctgagcgatagatgtgcgcatatcatttgtcatgcgctgagtactgacagatgaccgtgcaatttggaatcctggctagcggtcatatttgcgcacgaaatgatattgggtaaggatttatcttttatgaatggacacaaacacacaagtactagcggtggaggtggatttggattatcaacactatagttgaccttttttctttcaaatttattggattgcatctatatttggattttggatatattggattggatctatatttggattttggatatatgtggattacgaagttcacacttgatatggacatggaagcaaagcttgctggccgagtgtggcaagaaagctgagcgacggatagatgggagcacatcacttgccatgtactgacaaatgaccgtgcaatttggaatcctgggtagaggtcatttttgcgcacggaatgatattgggaaagcatttattttctatggacggacacaaacacacaagtatacacaggcacgtcaaaaatccatgtgtgacgatcttgtgctcaagatcaatcattcaaggttgagccatcagcacgaatggaccaaatggcattggaatctgaggctgctgtcaacaaacaattattgacagtatggactgcttttcctaatcacaattgatgaagcagctacgctccagtttgcggtgatgcggagggcccattcagccagacagcagctgaaaataacaaggcacacaaaacattctctcacgttccaggcttagacatggagcacacgactgtg

SEQ ID NO: 21 - DNA, 918 bp, Kochia scoparia
atgtcgcttctctcagatctcattaaccttgatctttctgattctactgataagatcattgctgagtacatatggattggtggatctggtatggacatgagaagtaaagctagaacattggaggggcctgtttctgatccgaaaaagcttccaaaatggaattatgatggatccagcactggtcaagctcctggtgaagacagtgaagttattctctacccacaagctatcttcagagatccattcaggaggggaaacaatatccttgttatgtgtgatgcctacaccccacaaggagagccgatcccaactaacaatagatgcaatgccgaaaagatattcagcaacccagaagttgccgctgaagtaccttggtatggtatcgagcaagaatatactttactgcagaaggatgtaaactggcccgttggctggcctttaggcggctttcctggtccacagggcccatactactgtggtgttggtgctgataaagctttcggaagggacatcgttgattcccactacaaagcctgcctttatgctggaattaacatcagtggaattaacggtgaagtgatgccaggacagtgggaatttcaagttggtccatctgttggaatttctgctggtgatgaattgtgggtagctcgttacatattggagaggattactgaggttgctggagttgctctttcatttgatccaaaacccattccaggtgattggaatggtgctggtgctcacacaaactacagcacaaaatctatgagggaagatggtggttacgaggtcattaagaaagctatcgaaaagcttgggttgaaacacgcggaacacatctctgcttatggtgagggaaatgaacgccgcctaactggtaaacatgaaacagccagcatttcaactttcctgtgg

SEQ ID NO: 22 - DNA, 867 bp, Kochia scoparia
atggcccagattctcgctcctagcatgcaatgtcagttgaaattctcaaaaagctcattaagctcgctagcatcgaacacgtggacctccattttgctaaaaggaaaccaaaagagatcgcttcattgctcaactaagttcaaggtatccgctgctctcaaatctgatgatggtactatcaacagggtagagcagctactcaatttggatgtcactccatacactgacaagattattgctgaatacatatggattggaggatctgggattgatgttcgcagtaaatccaggacaatctcaagacctattgaggatccatctgaacttcccaaatggaactttgatgggtcaagcactggacaagcgccgggagaagacagtgaagtaatcttataccctcaagcaatttttaaggatccttttcgtggtggtaacaatatcttggtgatctgtgatgcatacacaccagcaggtgaacccatcccaactaataaacgacacaaagctgcacagatcttcagcaaccaaaaggttgtttctgaggttccatggtttggaatagagcaggaatacacacttcttcaaccaaatgttaattggcccttgggatggcctgtaggagcttatcccggtcctcaaggtccatattattgtggtgttggtgctgaaaaatcttttggacgtgacatttctgatgctcactataaagcttgcctgtatgctggaattaacatcagtggcaccaatggggaagttatgcctggccagctgtatatccacttgtacctacagtgggaattccaggttggtcctagtgttgggattgaagcaggagatcatatctggtgtgccagatatattcttgag

SEQ ID NO: 23 - DNA, 360 bp, Kochia scoparia
actaaaacaatgagagaagatggtggtttcgaagtgataaaaaaagcgattttgaatctttcattacgccataaggagcatattagtgcatatggagaaggcaatgagagaaggttgactggaaagcatgaaactgccagcatcgattcattctcttggggtgttgccaaccgtggttgctcaatccgtgtgggccgtgatactgaaaaggaaggcaaaggatacttggaagatcgacgacctgcttcaaatatggacccatatgtggtaacaggtttgctagctgagaccacaatactctgggaacccacactcgaggctgaggcattagcagctcaaaaacttgctctcaacgtgtaa

SEQ ID NO: 24 - DNA, 5248 bp, Kochia scoparia
ataaagggaatttttaatttttttatatttaaatgctaaattaggtctcaaaatcttaggataaaaaatggatggaaagaaagggagagaatcctaactccgtatacgtatgaactttaaacattaaaaaaaaattgattaaagtttgtctaaaataatttccttcttttaaaaatgtgtaatgttgtttggatgcaagtaataaaaaacaaagaaagtatatacgaaagtatgtagactggtgtattggtggagggagatttaaatattgtgttagtttataaaaagattgctttattacttaggagactccaaaagattgctttatttacttagctagatttgttctaaaatatttcatcatttaataatccaaacccctttctctttcctctccttagacggcgtgggcccactcgacggacggcgttggtccactcgacggacggagttggaccactcgacggacggcgtctctgtgtctatctctcttgtgttgcgctgctgttattcttgcgttgcgttgctttgctttgctactgctgtgtggttgctcgatcttaatatcattgttaggatttcggtttttttaaggtattctacttctctcagtctctctcctcatcttcccccaattctgtgttgaattctttttaatgtttgaattattttgctagagttttgtgtgaattttgttggaattatttatgagttgtgtttcaatttctattgtttgtgaggttacacattattgtttggttttgggtgattttgggggcagaattattgatgattctggggctgaatttaaagaccaacaaagaactataatataataatcaaactgcaacaaacaaagcataacacacattggaaatcaagtttggtaatgggcatttaacacacattgagaatttgtaccttgaattggacaaaaatcagaagataattgtccaacattatcacaacaggaacaactggtatacagtaattaaatcaattgatacggtaaatcgaggaggtcccctcgataattggaaatggacaacgaaaaccttatctaaaaagttggaaccctttttttaaaaaaaaatgtttgatcaaatttagtccagagattcttttaaaacacaattttcaccactcaatcacaaacacccctatctactatggaaaagccatgctcagccatttttcctcctcttttcttttcaacccactatttgccctttcccattctccaaaattatattatcaatattattctttctatatactacaaacactatcttacatttggtcactctcttctctttctctctcctggcagttgactctctccattcccaattgattagcaacaaggtagtatctacattttcccacccatgtttctttcttgcattcaattcttgttactctttcttgtgctacttcactatcttggcaattgtgatctcgtcattaaatgcattgctgtctcatcatcgcatttatttcatctctcatatgagttaatgagtactacttgctattattgacaatgtataaggtgatctactttgtttctaataagtcactgctattctgtgctaaactagatttatacttatttacaactgatgactgctgatttagtgatttagtgatttagtgatttagatcgtactttctttgttttgctcgattttcggacgtcgattcgatatatacagatttgatgaacagcattgttgccaatgatcagtagtagtaatgttgttgaaagctttcagttatagtgatatcttccatctgctagttttttttagaggaaatcagtttttgctaggaggaaaaagggaattactaaaaaaaattataaatgttctttcaaaatttgagtgaagaaaataatggttattaaacactaattttgagctgaaagaatatgatcagatgcttttgtattctaatgtcttgaatcctaatatgcacctttaaaaccttttgtttttcaatgaaaaagtaaggaaaaagattatttgcattagtggcacgagtctaatctaataaccgtggtttcgtctcttctctttcaaaaattggaaaagtgttgatgtcattttctaacatttcctactaagtactaaccaaaacaaggttttctttccactaatagaattttcctttaccacatttatacagtataaaaatctctaactttagactttagagcatactatcacatcatggtgttgtcatagtatattcatattagagcaggtttagccccaagtctgaagacttgggatgaaattacctttattgtcttaagatttagatttaagattttcccatttttcttttaaaatcttagccagatctcaagttgatttcaaggctcaacttaagacttgaaacacgggacccaccctaatttaataatgtttgttttcatatagataacataaagagataaaaaaaaagtaaaatatcatggtatatatttaagactaggagtcttagggctaaagtgataaagttggacaagttttatggagtttaagaaaacattattttttgtgggaaccactaaaaaatgatgttacacccaagttttaagacttggtgctaagcttgctgttacaaattggtttcaatcataacagttattccttatctttgacttggaatttagtccaaatcttttgttgtggtgtactggtgtcgaggatacaacatggatacctaacgggaagaaaagagtttttgcaacttatattgtctgtctgtgtttaatgttgccacttctacgggaattctggtttctgtaatccaggattaaagagctgtcagctgttgtactgtaaattgtttgtgtaatagttttaatttttgtagggaaaggaccaaatatggcccagattctcgctcctagcatgcaatgtcagttgaaattctcaaaaagctcattaagctcgctagcatcgaacacgtggacctccattttgctaaaaggaaaccaaaagagatcgcttcattgctcaactaagttcaaggtatccgctgctctcaaatctgatgatggtactatcaacagggtagagcagctactcaatttggatgtcactccatacactgacaagattattgctgaatacatatggtatagtttcccattctgattttggcatctttatcgagggttattttttctcaaatatgcttgatgaggttatggtagaatcaacatattagggctttacttgcatggttgtattaggctcttttgttgtagaaaagcctgcttggtaattcagtgtccaggtgttgatggaactaattgaattatgattgttcattggaataggattggaggatctgggattgatgttcgcagtaaatccagggtatagtaacatccattctgtagcttgattattaaccacctattagatgctgactaatgttttcttaataataccagacaatctcaagacctattgaggatccatctgaacttcccaaatggaactttgatgggtcaagcactggacaagcgccgggagaagacagtgaagtaatcttatagtaagatcctgttacatctatgaatcttcatcattttccccataaattcattattcattatttccgagtctttcttttattctcgtcttttaatgactgatcattagtcattgttgtcttgcatttcttctgcaatagccctcaagcaatttttaaggatccttttcgtggtggtaacaatatcttggtgagtttgatagagcatatgaatcggttattctaaagttatagtgtttcttataaatagtaaatttatttgttaaggttgcaaccataatttatgatttgtaaatctaggtgatctgtgatgcatacacaccagcaggtgaacccatcccaactaataaacgacacaaagctgcacagatcttcagcaaccaaaaggttgtttctgaggttccatggtatgaagttccttgtactgataaaatccatttatgaattgttaataaccactttgcatttgaacattaaattttgtgtacaaagtttcctattataggaaggataattaattaatcataattgggagggtgaaattgagaagaaaaaagaggattgcatgaacagtccaatgcattttgttgctgacatgagaggcaatttggggctttgtagagctggctggattgtggaatgtaatcgacaggaaactgatgactgaccactgtgaatatgatctgttatgacacatttcatttttcgaatagaggaatttcattgccaggttgacctataacagtataactatgtcagaacagagcttctcgatttcaaaattgtgttggcttttcattttcaaataatcagaagagactcatcttttgttttctgtgttatcgttctactttaagcttttatactctttgttttagtcatttaatcatatttttacaggtttggaatagagcaggaatacacacttcttcaaccaaatgttaattggcccttgggatggcctgtaggagcttatcccggtcctcaagtatgttattcagttgctcctatttcatattcattttgtccaatgaagatgctttgttgtgttatagattagaatcgttttgttacgcaaaatgattttttttcgcattttctagggtccatattattgtggtgttggtgctgaaaaatcttttggacgtgacatttctgatgctcactataaagcttgcctgtatgctggaattaacatcagtggcaccaatggggaagttatgcctggccaggtattcccttacatcattctagtatgtcttccagtcataaatttgctttgaatcttgtaactcaatagctgtatatccacttgtacctacagtgggaattccaggttggtcctagtgttgggattgaagcaggagatcatatctggtgtgccagatatattcttgaggtattctcctgcaatttgtatgttcccctctgcgcttatcagttacaactatagttttgtaatttgctgccctatcgttttattattcattatttttctacttgaattctgcttgaaagataataagctactttgacacagactcgaagtgaaagtgaccatatgagaatcaaactgaccttggaattatgtgtgattaacaaccgaatctaatctcttatggaagacataaattaataatacttaataggctccaatgtggatgacctcccggaataa

SEQ ID NO: 25 - DNA, 3994 bp, Kochia scoparia
gtctattttatgagtaaaacaattcccgctaattttctccgggagatgcttgcaatctcaagaaatttaatggtgtgcaatctacatgtttgatggacaaagttttcccccaaattttaatgggacattgggtaggtgaaatactcaatcattagtgaagtacgtaattgcattctaaatcattaatttttttaactccttttgtgactaaataaatactttttttatcatttacaatttttactttgaccgtaatttttgacttatagataagaaaaaatatatttatcagaattcttgtcgaatttctctcaacttgtaattttttaaaatctaatgtttataatttttgcaaatacataattacagatattaatataaaaagttttatctcaacatgcgtgaaaagtacaattattataataattttgtcccaataaaatatttttgttgttaaagatttttaagaggttgaaaaagtagtatattttttttggctgaaaaagaatggagaataaacaatatcaaaacaataaataaagcagtatctaaaagtagagtgtaatttgtgtagtccactctttaaaagagtaccaaaagttgaggacttcctcatcaattcatcataccattttatattggttgtttcagacatcactctatatattaggcgtcattttgcgactcatttcacgcatttcttgatcacattctcacaatatctttctttctctcaatattttccataaacaatcacaacaacaacatgtcgcttctctcagatctcattaaccttgatctttctgattctactgataagatcattgctgagtacatatggtcagttctttattattgcacaccatcttttcgattttattacccaatgaataaagttttattttttctgggtttttctcttttagcagaaagatttcattaacaacttaattcacaatgaaggatttcagcttttttagttatgaatagtttgatgaagaaaagtgatgggttgtatcttatatattttatctgtttgttcttaatatgggatattttccagtgttacaatattgcttatttgactagcaaaatatatttatcttatttttcattgaacaaaatatgcacataatgattttctttttattggaagtcatagtgtagtaatcaagaacttgctgtgaatttattttcaggattggtggatctggtatggacatgagaagtaaagctagagtgagtttttttttttcttttttttttgttattgatatttttaaccttaaaccttcacctaccaaaatgaatgaataaataaataaataaataaatttttgtttatattacgaagtacatttaaaaaaaacagagatgatgagtttatgatggttggtttattgtgtagacattggaggggcctgtttctgatccgaaaaagcttccaaaatggaattatgatggatccagcactggtcaagctcctggtgaagacagtgaagttattctctagtatgtttttctgttctctttacttttgtaatcatttgatggtttaaatgagtctcttggttggtattggaaatcgatgtctacccactcggtaaatgacccaccacagatggatagatagattgatagacagacgggaattattatagtttagtcgaaactacaagaagaatctctcaaagccattaggtattagtcattgtctaaagatatttggacctactcatgtatagtaattactggtacaaacttcaatccgatgatcatatcataatttttgtggcccatgtattgatttttgttggttggaaggaatgttttctagcttctatttcgctttcgtatggtaacttattacttaaaataaaggacaagaaaatgatttttgattttggaaagtatcgagaaatgttttttgaaagctattttcttatgaatatactaaaaatgtgatctaatctttattaaataatgccatacttgtccactgaaaatatatttatttgggggtcaactgttaattaattcttgatcatggttgtaacagcccacaagctatcttcagagatccattcaggaggggaaacaatatccttgtgagtttcgttgttacctattttgttcgtgacatctgttagcatcattggctgttagtaggctaattcagtaatgctgatgatcacaactcacaagtaataatttggtgctgatttcaggttatgtgtgatgcctacaccccacaaggagagccgatcccaactaacaatagatgcaatgccgaaaagatattcagcaacccagaagttgccgctgaagtaccttggtaaaactttagtcaatgctggctggacaattgtttctagatttgatagttgtagtgaacttcagtattgtgaaatgtataggtatggtatcgagcaagaatatactttactgcagaaggatgtaaactggcccgttggctggcctttaggcggctttcctggtccacaggtgaattatttgagctattatctaatttgactgctgttttgcaatttctttgcattaaactttgcaactgtaaaatttcacctgtaagaaattacttaaatactgttgcgtacttgttatatttgtgcctgtcattatgtgatgtttaagaatgttttccactcataattttcctagtatttgagtaaagaagcttaagataatgatcagaccacaaaagagaatattgaaagaaacaggggaagtatgtgtttttgaaaaatatggacaggacacaaccaattaacagtcgttaaaaaaaaaataaaaatccgtgggttaaaagatttctgggactgctgactgtctagtcaaatggtttgcttggtaatttgattttattagaactttctatcgctcattaaggatttgtaacgaagtgacaattttaatgatacttacagggcccatactactgtggtgttggtgctgataaagctttcggaagggacatcgttgattcccactacaaagcctgcctttatgctggaattaacatcagtggaattaacggtgaagtgatgccaggacaggtgaattggaaatacctttctattactacaaaaaattgttatattagttcgagtattgtaatgcattctatgtggctaatgttttcttccttttcgttccttagtgggaatttcaagttggtccatctgttggaatttctgctggtgatgaattgtgggtagctcgttacatattggaggtactttaaaaaaagttgtcgatttttatcttttcagacgaattaaatcttacaaatgattttgaatgtcaatatgaaactgtgcattggtttttctgtttacagaggattactgaggttgctggagttgctctttcatttgatccaaaacccattccaggtgattggaatggtgctggtgctcacacaaactacaggtgtttgatttctaaacactttatcttagtcttatgagctctttgtatacaataatgatttattaatagatcatgatcactaatgcttgttaatgtttatagcacaaaatctatgagggaagatggtggttacgaggtcattaagaaagctatcgaaaagcttgggttgaaacacgcggaacacatctctgcttatggtgagggaaatgaacgccgcctaactggtaaacatgaaacagccagcatttcaactttcctgtgggtgagtattttctgaatatattctctccaatttgtaaccatcaaacttcacttgatctgcagtggtgccttttgatttttgaagtacttttcttttgtttcaaagttgcaaaattaccttttgcacatgattcctttcatctcagcttaacgtttgtgtccctcatttactctctatatggtccatctcatcatatcggctttcttcctacatatcctttaaaagaaccgacaggaaatctttaatcccatatggagtatattgtcttaaaagaagaaa

SEQ ID NO: 26 - DNA, 2204 bp, Kochia scoparia
attaaggaatgtaaacagctcagatatattagacctaggcacctagcaagttattaaaaataatgagcatgctggttggtttttgtagcactaaaacaatgagagaagatggtggtttcgaagtgataaaaaaagcgattttgaatctttcattacgccataaggagcatattagtgcatatggagaaggcaatgagagaaggttgactggaaagcatgaaactgccagcatcgattcattctcttgggtatagtcattatgccttccctttaattgacattatatttagagttatatttctcatgagagggtgttcaacaaacaatttgattatgtccagggtgttgccaaccgtggttgctcaatccgtgtgggccgtgatactgaaaaggaaggcaaaggtaacaatgctccttttgccataacttactgtcttacttgatatggcttgattttagagtcagggtttagaagactgtctatattttcctatgaatttacaatgtacaacgattgttggattttctcaaagttaattgttaacctaaaaacaaactagatgtctggttaaagaaaatgaacatggtacattttttatttatttttagatggttagagcttatcatccacttccgggagatcttgagattgattctcgcccttatggctttctaaacacccagtaaaaaacaaagctatataactgaactacctctatatgtttaaattattaatattatattaatgcggaagtaacttgcttcaagttgcatcatagcatgcgatttggctactcacattgtttagggtgtcatctatggactatatggattccctcaaatgtctgtagctttacttcaattttcctatcaagacaacaaaaacaagttgattcctgctagacaatgtttaatttcttgaatataaattacttcgtaaaaaacacattgttaatgttatgatttaatactcatcaggatacttggaagatcgacgacctgcttcaaatatggacccatatgtggtaacaggtttgctagctgagaccacaatactctgggaacccacactcgaggctgaggcattagcagctcaaaaacttgctctcaacgtgtaattccatccaagacaaacttaaacaagaataagaaatattgcatattgctgtcttaaacaactaagacaacttttcaactggatcgaacttgctatatttagtgattaggattgtttaaagctgtcaaagctttctccatatatcttagcttttctatgttttgttcattcaaggtttgatgaacaactatttgatatcgttgcccttaatgcgtttggtcccgttagttgccaaggccaattcgcatcgtgtttactactgagagtagttgaaatgcgaattttatttgtgttaatgtatttgttgccagaaagtgtcttggaagttttgtcaatggtttattgatctacttgctcatgaagttggatgagacattttgcataatgtgtcttttcactcccaaacgtgtagtaatttgttcgacttcctcatatcactcgatatctttgtgcaaagtacaaaccctaagggattagggaatttgttcttgttaacatttatgggaaaaaataatcaactttcgtgtttattttataaatagttgttgttgtgacaagtgtaacgagatatttgaaattagaggaactggggtgaacaggctccacttcaacaatgaatgttgattctccgacttgtgcttgtcaagacgttagaatcaatctccgattctctaagtctgaaagcttgagcatcctccggatcacctgaaacaaaagagataatctaatcgattatctcccttcgagtcaacacttctacaaaaaaaaaggtaatagagtaaatagagtgacttaaatgaaattttcctattttgttgaaaaagtaggtgagttaatgaatgaaagattgaggtgatgtaaaggaatctaacttgaaaaatgtgcaatcattgatgggtatttatattgtctatcaatgattgtcctcctaatggttatgcgacatgtggcatacgcctataggtcacttgttattggctagccttaatgatacgtgtcgtttaccgtattaaattaattatgggatatttccccatatacccctgaatttaagcctaataactcatataccctcgtgtttttagaa

SEQ ID NO: 27 - DNA, 135 bp, Kochia scoparia
cccctcacattagagaaaatagcccaaatatccttaatgagaccaaaaaccgtgaaatagttaacatcgttagtattttttccaattaacctctaattcaacctaattaacccataatctcatctctctcctcca

SEQ ID NO: 28 - DNA, 1673 bp, Lolium multiflorum
cgcgatcttgcagtcgccgaccgtttctcctcctctcccctcgtctgcgtctgctgccgcctctgctagcgttgacaagcaaggcggcagagtagctacctactagctagcctgatggcgcaggcggtggtgccggcgatgcagtgccagatgggcgcgctgggcaagtcggccgtccgtgccaggccggcggcggccgggggaagggtgtggggcgtcaggaggccgcccgcggcacggccgggttcaaggtgctggccctcggcccgagaccaccggggtcgtgcagaggatgaaccagctgctcgacatggacaccacgcccttcaccgacaagatcatcgcagagtacatctgggttggagggtctggaatcgacatcagaagcaaatcaaggacgatatcgaaaccggtggaggacccttccgagctaccgaagtggaactacgatggatcgagcacagggcaagctcctggagaagacagtgaagtcatcctatacccacaggctatattcaaggacccattccgaggaggcaacaacatcatagttatgtgtgacacgtacacaccacaaggggaacccatccctaccaacaaacgcgccagggctgcacaaattttcagtgacccaaaggtttcttcgcaagtgccatggtttggaatcgaacaggagtacactttgatgcagagagacgtgaactggcctcttggctggcctgttggagggtaccctggcccccagggtccatactactgcgccgtgggatcagacaagtcatttggccgtgacatatcagatgctcactacaaggcatgcctttacgctggaattgaaatcagtggaacaaacggggaggtcatgcctggtcagtgggagtaccaggttggacctagtgtgggtattgatgctggagatcacatatgggcttcaagatatcttctcgagagaatcacggagcaagctggtgtagtgctcactctggacccaaaaccaatccagggtgactggaatggagctggctgccacacaaattacagcacaaagagcatgcgtgaagatggaggttttgaagtgattaagaaagcaatcctgaacctttcacttcgtcacgacttgcacatcagtgaatatggtgaaggaaatgaacggagattgacagggttacatgagacagctagcatatcagacttttcatggggtgtagcaaaccgtggttgttctattcgggtggggcgagacactgaggcaaaagggaaaggatacctggaggaccggcgtccggcctcaaacatggacccatacactgtgactgccctactggctgaaaccacgattctctgggagccgacccttgaagcagaggctcttgctgccaagaagctggcgatgaacgtatgaaggactgaaaaggatgaatttctgggaaaaataaatcgacaacgacactgtttgtcgtccattcttcctgatcttgtggttccatcggggcactgtctgtacaaaatttacagtttgtagaaccactttgcctttcgcttgaacttcacatttgatctgggtctgtatctgattccacttggaactacgttaaaggataatgaaacacacaggattttgattctgctattttatttcctttgaatggttcatctttaagactagtgtcatg

SEQ ID NO: 29 - DNA, 820 bp, Lolium multiflorum
ccagccttcctcccttaatcctgctcctcgccctcagtccccacgccatggcgctcctcaccgatctcctcaacctcgacctctccggctccacggagaagatcatcgccgagtacatatggatcggcggatctggcatggatctcaggagcaaggccaggactctccccggcccggtctctgatcccagcaagctgcccaagtggaactacgacggctccagcaccggccaggcccccggcgaggacagcgaggtcatcctatacccacaggctatcttcaaggacccattcaggaggggaaacaacatccttgtcatgtgcgattgctacaccccagctggcgagcccatccccaccaacaagaggaacgcggctgctaagatcttcagcaaccctgctgttgctgccgaggagccatggtacggtattgagcaggagtacaccctcctgcagaaggatatcaactggcctcttggctggcccgttggtgggttcccggtcctcagggtccttactactgcagtatcggtgctgagaagtcctttggtcgtgacatcgttgactcccactacaaggcttgcctcttcgccggcatcaacatcagtggcatcaatggcgaggtcatgcccggacagtgggagttccaagttggcccaagtgttggcatttctgctggtgaccaagtgtgggttgctcgctacattcttgagaggatcactgagatcgctggagtcgttgtcacattcgaccccaagcccatcccaggtgactggaacggtgctggtgctcacacaaactacagcactgagtcaatgagg

SEQ ID NO: 30 - DNA, 1888 bp, Lolium multiflorum
cccttggttcctgaaactacttgcactgtttggaaatgcaggaaagagttctacccagaaataaaattcaaggacattatgcaagcataattcttggggagtagaaagcccttaaactgtctaacctgggtcttaggttctttagctcattttacccatatggccatataacgaatatggatgccattctgatgattttgaatagttctgggccaaatccacacccttgaattcgctattctgcaccctctacgtgttgagtgttatcaatttgaaaaatgttccttcactcatacatatctagtcaccaactgatggcctagctcacagttgaaagaaaaatacattggcaccaaattgatatcttactatactattatcagtacccattcattatgacatggtaatttgcatggagccatacactgacagcgctgctgactgaaactaaaaggacttcatcttcatgccaacaggatacctggaggaccggcgtccggcctcaaacatggacccatacactgtgactgccctactggctgaaaccacgattctctgggagccgacccttgaagcagaggctcttgctgccaagaagctggcgatgaacgtatgaaggactgaaaaggatgaatttctgggaaaaataaatcgacaacgacactgtttgtcgtccattcttcctgatcttgtggttccatcggggcactgtctgtacaaaatttacagtttgtagaaccactttgcctttcgcttgaacttcacatttgatctgggtctgtatctgattccacttggaactacgttaaaggataatgaaacacacaggattttgattctgctattttatttcctttgaatggttcaatctttaagactagtgtcatgggtggttcgtctgtctcgagaatttatctatagcgttaaagtttctcatgtttataaagctttgatggggaatgttggtgctattcctgcaattaaatggatgtgggatggttgttgtcaacagaggcacaaggttttcttttggccgcttgttcataattgcctcaacaccagggccctgctccaacgaaagaaaaacaccagggccctgctccaacgaaagaattttgtgatgaatgattattcttgtgtcatgtgtaatcagcagcatcttgagacaagagatcatctgttcttccaatgtccttttgttgtgctgtgctggcaatatctctgtcctctttgaatttccctcctttggggtagtttgatcttcaagatacattatctggccttaagcttgctatctccaagcctttctttatggagctgataatgttgatcatatggtttatatggctcacccgcaatgattttatcttcaaggctgttcctccaatgattttatcttcaaagctgttcctccaagtgtttacagatgtcggaagagatttaaggatgggcttgcccttctagttcacaaagcgaagagaaaatcttatcatggcatagtcacttgggtggaaattttagatagcctttgctttctctttgggcttatggcctcttttatttgctcctctcaagcaactgttctcttttgtagaccttttaagcctttataaataaaataaaaaatatacagtggggaaactcactgtttagcctaaaaaaagaatttatctatagccataccaatataatgccatgatactaacacaagttaaaaatcagtggcgaagctagagattctgaccagtagggccagttatcttgtttatggtgtaatttttcagtaatgagcaatgtaaagaaccacatcaatgaagatttctgaatttctactgggttcgtttgaacacgagaactgtatgcaagctctaccctgtgaaaataatca

SEQ ID NO: 31 - DNA, 1737 bp, Lolium multiflorum
tgaaattattgcaaacagatgacgctcctaaaaccggtaatctgggcctccaattattggtgcgcctggtcagagccttccaagttccaaaactatgaatggaaaacaataacaatggccatgccggtcaatcactgtacatataaacaacccaggccgttgaggtttggctgttgctcgtgtttattttgattggagaggtcgcctgggcttggccggctcgcatgtggagacggacgtgacaaggagaggcagccgcatctttcatatccagagcacaaaaacacattgtaaactctatccaagatgtgtgtgcctgccttctgagcggcgcttccctttgctgtctttgcctccggtggtgctgcaagggccgccagaaatctcgtccacccaaagccctatcgcctaatcaagagccagatgccactgccccagccgcggccactagaatctctctcgcaaatctaaaatacttatacgcctcttgctctgcccccgtagatagataaataattccagcgcgatcttgcagtcgccgaccgtttctcctcctctcccctcgtctgcccgtctgctgccgcctctggtgagtggtcgaaccaatgcctagtttcgttccttctctgttgcattcgctgctggctagtgatcgatccgatgtggtaatggcgcctatctgctttggttggttgatcagctagcgttgacaagcaaggcggcagagtagctacctactagctagcctgatggcgcaggcggtggtgccggcgatgcagtgccagatgggcgcgctgggcaagtcggccgtccgtgccagggccgggggaagggtgtggggcgtcaggagggccgcccgcggcacggccgggttcaaggtgctggccctcggcccggagaccaccggggtggtgcagaggatgaaccagctgctcgacatggacaccacgcccttcaccgacaagatcatcgcagagtacatctggtacgtacgtcctcccaatgttgcattcctcggttgcgccggagcgggctttgttcgcttccgttgactccccacgacagaacaccaccagtagcttcagataggccaaacccgcactttttgggactagattagtgccggggcaagcagattcgccccccttttaaggtttgatgatagtggttatttaattttctgtctaaagcttcctgggcatggtgggtgatgagtgacgaattcaaaagtgcttgctttttagttagttccagcacttgaataagcttaggaaaatgcacatcgcactttgggggagcaataagggtcaaacaaattggtcctggcatctactaagtactagtacctctgtggcaaaatataagacgctttggtagcctatttttgggacacatgtaatattactagtattttaacaattctgcctttctctcttcacattccgcagggttggagggtctggaatcgacatcagaagcaaatcaagggtacgcagcccattatattcatgaaattgacattagatttgtttttttttttgaaaggatttttttctagaagtttagcggatgagaagttggttttgtatgcagagttctccttccttacatcctttttggttcctgacaagaaaatttaatgcttgcatttcagacgatatcgaaaccggtggaggacccttccgagctaccgaaatggaactacgatggatcgagcacagggcaagctccgggaga

SEQ ID NO: 32 - DNA, 975 bp, Lolium multiflorum
atgaccagaatatggtcaataaagcaattggttggttaaccctttagctgcatgcactatgaacttgtgatttgttcgaaacttcagttttaattcatttcctgaaaaccgtcagaccatttttcttcaaaatatgatgaaaccaaatcctataactggccagccctttggtcaaatcatatttcccatctgtaaagccttctaattatcatcgtactgaccttaatcagagaatcacggagcaagctggtgtagtgctcactctggacccaaaaccaatccaggtatatccctgtaagttgttggaagcactttatatattgaaacttagtaaactgaagattaatttgatatagggtgactggaatggagctggctgccacacaaattacaggttccaatctcttctgttaaataatgcatttttcctgcttaacatttacagaatatcttattgtatattaacaatacatcagaaaacctaatatagctttgctttagtaaatgctgtggggttcacatcagaaggaaatgtatgctgggactaatagaaaaaacccctccaaatacaaatttaaactggctataaatgggaaaccattattagtcgtcggttttttattgagcatgattcagaataagcatttattcacattagttaatcgctaaatttggttagttgtttttctcaatactcgatacagtttgtccttaatgtgcaagtgagaaactatcttttcttgttgttgcaaatatagcacaaagagcatgcgtgaagatggaggttttgcagtgattaagaaagcaatcctgaacctttcacttcgtcacgacttgcacatcagtgaatatggtgaaggaaatgaacggagattgacagggttacatgagacagctagcatatcagacttttcatgggtacgggtggagcagcctttcattatttttcagctgtaatttacttcatgtttattt

SEQ ID NO: 33 - DNA, 781 bp, Lolium multiflorum
ccacttgcattattcatttctggttttgcttttatgcagctatactgaaagggtcaatagtggacacttttacctgtttgttacatgtgccaagtgccatgtgagttaaaatgatttttttttttgcctttcaggttatgtgtgacacgtacacaccacaaggggaacccatccctaccaacaaacgcgccagggctgcacaaattttcagtgacccaaaggtttcttcgcaagtgccatggtaattatgcgttgagcacctgtatgccgtgcaaaggcctgctgttcttttacctccctttattcgcctgcagactatagagttgaaaaatcttcttttctaggtttggaatcgaacaggagtacactttgatgcagagagacgtgaactggcctcttggctggcctgttggagggtaccctggcccccaggtactgtaccaagaagcttcatttactattcaaaaaataaatcttaggctggctgaaatacactttttagttaaacactgttgagtagtaatattgtgctgaaatattgcagggtccatactactgcgccgtgggatcagacaagtcatttggccgtgacatatcggatgctcactacaaggcatgcctttacgctggaattgaaatcagtggaacaaacggggaggtcatgcctggtcaggtgagcctttgtgtttatacgtgcgcacgtatacttatcttgtgtgaacccgaaccagagatgttttttacattttctttctaatgaagtgtttaataagtggaattt

SEQ ID NO: 34 - DNA, 766 bp, Lolium multiflorum
caaacattagatgctctacgattaggtgttggagattataatcgggatacaggtatgtatgggatgatgtctaattatcatatggtgctgactatgaaagtatgaggaataatgctagatattttgcatcagatgaaaagtacaaatataaataatttccaacgtaagagctaagaaaaacattagaaattcagttcctggaaaagaaaagctactaccaggaaagtgatcagagcatttggcacctttgtatccactttcctgccttatctgttttatgatagcactagcacacacagtaggcttatctctgaatccaaaaacaggtacggtatcgagcaggagtacaccctccttcagaaggacgtgaactggccccttggctggcccattggtggctaccctggtcctcagggcccctactactgcgccgccggtgcggacaaggcgttcggccgtgacatcgttgacgctcactacaaggcctgcctctacgccgggatcaacatcagcggcatcaacggggaggtcatgcccggccaggtactacacatcctcttgcagcaacttggtttctgtcttgtcagaaacacttctaacggtgatatggctgatgcgtgtgccgccaactctgactgtgaacctgattcctgtgtgacagtgggagttccaagttggcccgtccgttgggatcgccgcctccgaccagctctgggtggcccgctacatcctcgaggtcagtgccctccgaacatattcgattctc

SEQ ID NO: 35 - DNA, 575 bp, Lolium multiflorum
gtacacaccacaaggggaacccatccctaccaacaaacgcgccagggctgcacaaattttcagtgacccaaaggtttcttcgcaagtgccatggtaattatgcgttgagcacctgtatgccgtgcaaaggcctgctgttcttttacctccctttatttgcctacagactgtagagttgaaaaaacttcttttctaggtttggaatcgaacaggagtacactttgatgcagagagacgtgaactggcctcttggctggcctgttagagggtaccctggcccccaggtactgtaccaagaagattgatttactatacaaaaataaagcttaggctggctgaaatacactttattagttaaacactgttgagtagtaatattgtgctgaaatattgcagggtccatactactgcgccgtgggatcagacaagtcatttggccgtgacatatcagatgctcactacaaggcatgcctttacgctggaattgaaatcagtggaacaaacggggaggtcatgcctggtcaggtgagcctttgtgtttatatgtgcgcacgtatacttatcttgtgtgaacc

SEQ ID NO: 36 - DNA, 455 bp, Lolium multiflorum
gtatttaacaattctgcctttctctcttcacatttcgcagggttggaggatctggaattgacataagaagcaaatcaagggtacgcagcccacaatcttcatggacttgacattatatatatttttttaaatgatttcttttctagaagtttaggggatgggaagttggttttgtacgcagagtactacttccttactaccttttcggctcctgacaagaaaatttaatgcctgcatttcagacgatatcgaaaccggtggaggacccttccgagctacccaagtggaactacgatggatcgagcacagggcaggctcctggagaagacagtgaagtcatcctatagtaagggggaaattgcagtatatgtgttcttcatccttgcatataagaagtatcctagatttatacatgtgttactctctttatgtttttcgtatcctgtttcagccca

SEQ ID NO: 37 - DNA, 1270 bp, Abutilon theophrasti
ttttcccctctctttcttcttagtttcgctgttgttcaatatgttgctcctcaatgatctcatcaacctcgacctcaccgagaccaccgagaagatcatagccgaatacatatggatcggtggatctggtatggatttgagaagcaaagcaagaactttgcctggaccggtgtcggaccctgcaaaacttccgaaatggaactacgatggttcaagcacaaatcaagctcctggagacgatagtgaagtgattctatatcctcaagctatattcaaggatccattcagaagaggaaacaacatcttggtgatgtgcgatgcttacacaccagccggtgagcccattcccacgaacaagagatataatgcagccaagatatttagcaaccctgatgttgttgccgaggaaccatggtatggcattgagcaagagtacactcttcttcaaaaggataccaagtggcctcttggatggcctgttggaggatttccaggaccacagggcccctactactgtggagtaggagctgacaagtcctttggcagggacattgtggattcccactacaaggcttgcctttatgctggcattaacatcagtggaatcaacggtgaagttatgcccggtcaatgggagttccaagttggtccagcggttggaatatctgcgggtgatcaagtatggatggctcgatacatactcgagcgaatcaccgaaattgcaggagtggttctttctttcgatcccaaacccattccgggtgactggaatggtgctggtgctcataccaactacagcacaaagtccatgagaaatgatggcggcatcaaagttatcaaggaggcgattgagaagttgggtaagcgccacaaggagcacattgccgcctacggtgagggtaacgagagacgcttaactggtcgtcacgagactgctgatatcaacacattctcttggggtgtggcaaacaggggagcctccatccgtgttggccgtgacaccgataaggacggaaaaggctacttcgaagacagaaggccggcatcaaacatggatccttatgtcgtgacatcgatgattgccgagaccaccattatatggaagccttgagaggtgaaaattggagcttgcggatgatgagaaagaaaatcctacattcatattaataaccccttctctcatcttctttgttgtgccagtggttgaacttgtagttttattgctttggatttgctggtttgccattaaaattctgcccgtctttttttt

SEQ ID NO: 38 - DNA, 1252 bp, Abutilon theophrasti
aattttcaatctgttgtctagtttgttttatcttatgttcttttggacgttcttccaaccttcagacaatagcaaagccagttgagcatccctctgaacttcccaagtggaactatgatggatcaagcaccggtcaagcacctggtgatgacagtgaagttattttatagtaagatctttaatgaaaactaaaacttcctttattgcttgttttcatcaaaacactatttgactgaaaattttatccagccctcaggcaatctttaaggaccctttccgaggaggtaacaatatcttggtgagtattaacaaaggcttataattgaaaatttctgatgaattgttgaaatttttgtgggtaaattatatagtgtggttaacattttcatgcatgtttcccataggttatttgtgatgcatacacaccggctggtgagcccattccaacgaacaagcgccacaaagctgccgagattttcagtaacaagaaggtgatagatgaaataccatggtacgaattactttattgtaactatcttattcttttgttcaaatctggattaattgagaattatattgtaatcttgtgttcgctttattctatctcggcattcatacaaaaggaaatgccctcattttgttgtactattctgttaaggtttgggattgagcaagagtacaccttacttcaacaaaatgtaaaatggcctttgggttggcctgttggaggctaccccggtcctcaggtaataatatgactcgatttttatacaggagtaaattggttgtagggggtctgtaaattcttgctaataacatagtcctacttgaacttatacttgaatgtggttgtttgatgccaaattcagggtccttattactgtggagctggagctgacaagtcattcgggcgtgacatctcagatgctcattacaaggcttgcttatatgctggcatcaacattagtggcacccaatggggaggttatgcccggccaggtctgctgcctttgagtcctcatcttgctaatgaaaatgaagtgctattgcagtcatgtttgtttgtgtattaggtatcaccatttgattctgtaaattactatgcagtgggagtatcaagttggtccaagtgttggtattgaggctggagatcatatctggtgttctagatacattcttgaggtatttattctcacatgatttggttaatcttatggaggccgctgcaaaattccagccttcgcacacatag

SEQ ID NO: 39 - DNA, 885 bp, Abutilon theophrasti
tggatggcctcttggtggctatcctggacctcaggtactcccatctttctttctttcaaaagcaatgtttaaatgttggatgatatatatatcggactggacggagagccgatttgttcaaccaatcggtgaatatgtaaccctgattcgggtgaatattttgttgatagggtccctactattgtggtgttggtgtggacaaagcctatgggcgtgacattgtggattctcactacaaagcttgtttatatgctggaatcaatatcagtggcatcaatggagaagtgatgccagggcaggtaaaaatgactggttttttactcttttatgcttctctcggttattggttatgttaaagcttaatctatcttctattttctttacagtgggaatttcaggtcggtccatcacttggcatctctgctggagacgaattgtgggttgcacgttacattttggaggtaatcaacctatgttactctcgaacttgagtgtcgtagtttttaaaggttcttcatgtgtttggttatccttggtcatatctatcaaccccacatatactcgaacaagaatgaaaaatcgaagcaacatagttatcgagggtttcacttcgactctcttcagttattttaatctatgtttctgaaatacagaggattaccgagattgctggagtggtgctctcctttgatcctaagccaattcaggttcgaattgctggttccattagccttttcttttgctccggatagactcgaaatcttaagcttattacaattttgttttaactttgatcccagggagactggaatggtgctggtgctcacacaaactacaggtaccatttgaatctacttcaagaagttggtggaggaactgaatgat

SEQ ID NO: 40 - DNA, 1075 bp, Abutilon theophrasti
gtatggatggctcgatacatactcgaggtatgatctgtatactatagtgtatttgattaatgaatttttacctctttaaggattgaagtttaactaataaacttctgtttttcttgttttaaacagcgaatcaccgaaattgcaggagtggttctttctttttgtatcccaaacccattccggtttgtttttctatgctacattttctcctatattcaactttatatcgccttttatgttctttttccccttttttctcgtcctgcctctttaacttttcatctttgcatttcatttcgataactagggtgactggaatggtgctggtgctcataccaactacaggtagatactaaactcattgtgcacttcacttttataaagtatataatatatacccttttgcatggatgaagagttaattagttgaattgaaactctctcagcacaaagtccatgagaaatgatggcggcatcaaagttatcaaggaggcgattgagaagttgggtaagcgccacaaggagcacattgccgcctacggtgagggtaacgagagacgcttaactggtcgtcacgagactgctgatatcaacacattctcttgggtaagtttgaacaattgtaggcctatagcatcccctttccaacaagctagaatggtattgaattctcttatggttaaacatctccattttctaatttcttgttgctgttttgattgccatgtccaaactccagggtgtggcaaacaggggagcctccatccgtgttggccgtgacaccgataaggacggaaaaggttagcactatgcagatattgatcaaacttcgattctaatatgaacctccatttttttctcattccttgaattttaacattcatggtcatgtaattcgcaggctacttcgaagacagaaggccggcatcaaacatggatccttatgtcgtgacatcgatgattgccgagaccaccattatatggaagccttgagaggttaaaattggagcttgcggatgatgagaaagaaaatcctccattcatattaaaaaacccctctctcatcttctttgtt

SEQ ID NO: 41 - DNA, 1603 bp, Amaranthus albus
ttctttatctctctatattcatctctctctctagcttattcacgacgccgatcacccttttccgaacccaggtaaaagtgaccaaacatggcacagatacttgcaccttacatgcaatgtcagctgaagttctcaaaaggttcaacaagttcaatgacatcaaatccttggacttcaatatttcttaaagaaaataaaaagggatcaattaaatgctcgagtaagttcagagtatgtgcttctctccaatctgaaaatagcacaataaacagggtggagcagctactcaacttggatgtcactccatacactgacaagataattgcagagtacatttggattggaggatctggtattgatgtccgtagcaaatcaaggactatctctaaacctgttgagcacccatctgagcttcccaagtggaattatgatggctcaagcacaggacaagcaccaggagaggacagtgaagtaatcttataccctcaagcaattttcaaggatccattccgtggtggtaataatatccttgtaatctgtgacacatacacaccagcaggcgaacccatccccactaataaaagatacagggctgcacagatattcagcgacccaaaggttgtttctgagattccatggttcggaatagagcaggaatacactttgctccaacaaaatgttaaatggcctttgggatggcctgtgggagcctatcctggtcctcagggtccatactattgtggtgctggtgctgacaaatcttttggacgtgacatatctgatgctcattacaaagcttgcttgtatgctggtattaacattagtggcacaaatggggaagttatgcctggccagtgggaattccaagttggtccaagtgttggcattgaagctggagatcatatctggtgtgctagatatattctggagagaattactgaacaagctggtgtggttctaactcttgatccaaagcctattgagggtgattggaatggtgcaggttgccatacaaattacagtacaaagaccatgagagaagatggtggttatgaagcaattaagaaggcaattttgaatctatcattacgtcacaaggaccatatcagtgcatatggagaaggaaatgaacgaagattgacagggaagcacgagaccgccagcatcgacacattctcttggggtgttgccaatcgtggttgctctatccgtgtgggtcgtgacacggaaaaggcaggcaaaggttatctggaagataggcggcctgcttcaaacatggacccatacgtggtaacaggtttgctcgcagaaactacaatactttgggaaccaacacttgaggctgaggcactcgcagcccaaaaactcgctcttaatgtgtaattcaatcataaatcgtacgagaatatcgcatattcttgagggaggaactgtttcacgagccccgaatttgcttgtttttagtttttagtatcctgggactgggactgggtatgtatttcttgacctttgcttctggtcgtttgttttgggagttagaagagaagaatagtttgtgattgttacctatttatttttgctcttatgaagctcaagctcagca

SEQ ID NO: 42 - DNA, 514 bp, Amaranthus chlorostachys
ctctctagctcacccttttccgaacccaggtataagtgatcaaacatggcacaaatacttgcaccttacatgcaatgtcagatgaagttctcaaaaggctcaacaagttcaatgacatcaaatccttggacttcaatatttcttaaagaaaataaaaagggatcaattaaatgctctagtaagttcagagtatgtgcttctctccaatctgaaaatagcacaataaacagggtggagcagctactcaacttggatgtcactccatacactgacaagataattgcagagtacatttggattggaggatctggtattgatgttcgtagcaaatcaaggacaatctctaaacctgttgagcacccatctgagcttcccaagtggaattatgatggctcaagcactggacaagcgccaggagaggacagtgaagtaatcttataccctcaagcaattttcaaggatccgttccgtggtggtaataatatccttgtaatctgtgacacatacacaccag

SEQ ID NO: 43 - DNA, 1140 bp, Amaranthus chlorostachys
tacagggctgcacagatctttagcgacccaaaggttgtttctgagattccatggtttggaatagagcaggaatacacgttgctccaacaaaatgttaaatggcctttgggatggcctgttggagcctatcctggtcctcagggtccatactattgtggtgctggtgctgacaaatcttttggacgtgacatatctgatgctcattacaaagcttgcttgtatgctggcatcaacattagtggcacaaatggggaagttatgcctggccagtgggaattccaagttggcccaagtgttggtattgaagctggagatcatatctggtgtgcaagatatattcttgagagaattactgaacaagctggtgtggttctgactcttgatccaaagcctattgagggtgattggaatggtgcaggttgccatacaaattacagtacaaagaccatgagagaagatggtggttatgaagcaattaagaaggcaattttgaatctatcattacgccacaaggaccatatcagtgcatatggagaaggaaatgaacgaagattgacagggaagcacgagaccgccagcatcgacactttctcttggggtgttgccaatcgtggttgctctatccgtgtgggccgtgacacagaaaaagcaggcaaaggttatctggaagacaggcggcctgcctcaaacatggacccatacgtggtgacaggtttgctcgcagaaactacaatactttgggaaccaacacttgaggctgaggcactagcagcccaaaaactcgctcttaatgtgtaattcaaccataatcgtgccagaatatcgcatattcatgaacgagggaaccctttcacgtgcccagaatttgcttatttttagtttttagtatcctgggtatgtgagtgttttcattcatgacctttgcttctgatcattgtttgttttgggagttcaagagaagaataatttgtaactgttgccttcattatttttgctcttatgaagctcaagctcagtattagttatattccagattaaggaatgaacttcaaaatcctttgttactcatcttcaactccattgaatatacacttatgtccctttagtttgctacaattacactatgattacaaatttaca

SEQ ID NO: 44 - DNA, 1691 bp, Amaranthus graecizans
cattattccattctacccatacttgggacaatcatacctttataacacctttaaccatacacactctctcttctttatctctctaaattcttcactctctctctagttagttgacgccgccgaccaccttttccgaacccagtgaccaattatggcacagatacttgcacctaacatgcaatgtcagatgaagttctccaaagtctcgacaagttcaatgacattaagtccttggacttccatatttctgaaagaaaaccaaaagaaatcgattaaatgctctagtaagttcagagtatgtgcttctctcaagtctgaaaacagcactgtaaacagggtggagcagctactcaacttggatgtcactccatacactgacaagattattgcggagtacatttggattggaggatctggtattgatgtccgtagcaaatcaaggactatctctaaacctgttgagcacccatctgagcttcccaagtggaattatgatggctcaagcacaggacaagcaccaggagaggatagtgaagtaatcttataccctcaagcaattttcaaggatccattccgtggtggtaataatatccttgtaatctgtgacacatacaccccagcaggcgaacctattcccactaacaaaagatacagggctgcacagatattcagcgacccaaaggttgtttctgaggttccatggtttggaatagagcaggaatacactttgctccaacaaaatgttaaatggcctttgggatggcctgtgggagcctatcctggtcctcagggtccatactattgtggtgctggtgctgacaaatcttttggacgtgacatatctgatgctcattacaaagcttgcttgtatgctggtattaacattagtggcacaaatggggaagttatgcctggccagtgggaattccaagttggtccaagtgttggcattgaagctggagatcatatctggtgtgctagatatattctggagagaattactgaacaagctggtgtggttctgactcttgatccaaagcctattgagggtgattggaatggtgcaggttgccatacaaattacagtacaaagaccatgagagaagatggtggttatgaagcaattaagaaggcaattttgaatctatcattacgtcacaaggaccatatcagtgcatatggagaaggaaatgaacgaagattgacagggaagcacgagaccgccagcatcgacacattctcttggggtgttgccaatcgtggttgctctatccgtgtgggtcgtgacacggaaaaggcaggcaaaggttatctagaagataggcggcctgcctcaaacatggacccatacgtggtaacaggtttgctcgcagaaactacaatactttgggaacccacacttgaggccgagtcacttgcagctcaaaaactcgctcttaatgtgtaattccaaccataaaacgaagcagaatatctcatattcttgagggagggaactgtttcacgagccccgaatttgcttgtttttagtttttagtatcctgggactgggactgggtatgtatttcttgacctttgcttctggtcgtttgttttgggagttagaagagaagaatagtttgtgattgttacctatttatttttgctcttatgaagctcaagctcagcattagttctattccagtttaaag

SEQ ID NO: 45 - DNA, 1883 bp, Amaranthus hybridus
cccgtcgttcccgtccggttccgatctgtaaacaatcaaaaccgacgcttctgatagccaagatcaatgcactgcaatcggctagaacggttcctcgacgtagtcgtctccttctaatagatgacagccaagaaaacgccacaaaatcgtgttcaaatgaaaagatatacggcttagattcaatgctcaaatgtacaagtccaggctacactccatccttctttctcactcctttatctctctctctctagctcacccttttccgaacccaggtaaaagtgatcaaacatggcacaaatacttgcaccttacatgcaatgtcagatgaagttctcaaaaggctcaacaagttcaatgacatcaaatccttggacttcaatatttcttaaagaaaataaaaagggatcaattaaatgctctagtaagtttagagtatgtgcttctctccaatctgaaaatagcacaataaacagggtggagcagctactcaacttggatgtcactccatacactgacaagataattgcagagtacatttggattggaggatctggtattgatgttcgtagcaaatcaaggacaatctctaaacctgttgagcacccatctgagcttcccaagtggaattatgatggctcaagcactggacaagcgccaggagaggacagtgaagtaatcttataccctcaagcaattttcaaggatccgttccgtggtggtaataatatccttgtaatctgtgacacatacacaccagcaggcgaacccatccccactaataaaagatacagggctgcacagatctttagcgacccaaaggttgtttctgagattccatggtttggaatagagcaggaatacacgttgctccaacaaaacgttaaatggcctttgggatggcctgttggagcctatcctggtcctcagggtccatactattgtggtgctggtgctgacaaatcttttggacgtgacatatctgatgctcattacaaagcttgcttgtatgctggcatcaacattagtggcacaaatggggaagttatgcctggccagtgggaattccaagttggcccaagtgttggtattgaagctggagatcatatctggtgtgcaagatatattcttgagagaatcactgaacaagctggtgtggttctgactttggatccaaagcctattgagggtgattggaacggtgcaggttgccataccaattacagtacaaagaccatgagagaagatggtggttatgaagcaattaagaaggcaattttgaatctatcattacgccacaaggaccatatcagtgcatatggagaaggaaatgaacgaagattgacagggaagcacgagaccgccagcatcgacacattctcttggggtgttgccaatcgtggttgctctatccgtgtgggccgtgacacagaaaaagcaggcaaaggttatctggaagacaggcggcctgcctcaaacatggacccatacgtggtgacaggtttgctcgcagaaactacaatactttgggaaccaacacttgaggctgaggcactagcagcccaaaaactcgctcttaatgtgtaattcaatcataatcgtgccagaatatcgcatattcatgaacgagggaactctttcacgtgcccagaatttgcttatttttagtttttagtatcctgggtatgtgagtgttttcattcatgacctttgcttctgatcattgtttgttttgggagttcaagagaagaataatttgtaactgttgccttcattatttttgctactccgccaattgtagtacatcatgaaaatatgactgcaacagttaagctactccgccgattcggaaaatatagattgaaggtgatatttaagttttcctt

SEQ ID NO: 46 - DNA, 1683 bp, Amaranthus lividus
cccatttcattctgcttactctccatccttctttctcactcctttatctctctctctctagctcacccttttccgaacccaggtaaaagtgatcaaacatggcacaaatacttgcaccttacatgcaatgtcagatgaagttctcaaaaggctcaacaagttcaatgacatcaaatccttggacttcaatatttcttaaagaaaataaaaagggatcaattaaatgctctagtaagttcagagtatgtgcttctctccaatctgaaaatagcacaataaacagggtggagcagctactcaacttggatgtcactccatacactgacaagataattgcagagtacatttggattggaggatctggtattgatgttcgtagcaaatcaaggacaatctctaaacctgttgagcacccatctgagcttcccaagtggaattatgatggctcaagcactggacaagcgccaggagaggacagtgaagtaatcttataccctcaagcaattttcaaggatccgttccgtggtggtaataatatccttgtaatctgtgacacatacacaccagcaggcgaacccatccccactaataaaagatacagggctgcacagatctttagcgacccaaaggttgtttctgagattccatggtttggaatagagcaggaatacacgttgctccaacaaaatgttaaatggcctttgggatggcctgttggagcctatcctggtcctcagggtccatactattgtggtgctggtgctgacaaatcttttggacgtgacatatctgatgctcattacaaagcttgcttgtatgctggcatcaacattagtggcacaaatggggaagttatgcctggccagtgggaattccaagttggcccaagtgttggtattgaagctggagatcatatctggtgtgcaagatatattcttgagagaattactgaacaagctggtgtggttctgactcttgatccaaagcctattgagggtgattggaacggtgcaggttgccataccaattacagtacaaagaccatgagagaagatggtggttatgaagcaattaagaaggcaattttgaatctatcattacgccacaaggaccatatcagtgcatatggagaaggaaatgaacgaagattgacagggaagcacgagaccgccagcatcgacactttctcttggggtgttgccaatcgtggttgctctatccgtgtgggccgtgacacagaaaaagcaggcaaaggttatctggaagacaggcggcctgcctcaaacatggacccatacgtggtgacaggtttgctcgcagaaactacaatactttgggaaccaacacttgaggctgaggcactagcagcccaaaaactcgctcttaatgtgtaattcaaccataatcgtgccagaatatcgcatattcatgaacgagggaactctttcacgtgcccagaatttgcttattttagttttagtatcctgggtatgtgagtgttttcattcatgacctttgcttctgatcattgtttgttttgggagttcaagagaagaataatttgtaactgttgccttcattatttttgctactccgccaattgtagaacaccatgaaaatatgactgcaacagttaagctactccgccgattcggaaaatatagattgaaggtgatatttaag

SEQ ID NO: 47 - DNA, 1743 bp, Amaranthus spinosus
ccattattccacactccacactacccatttcattctgctcactctccatccttctttctcgctcctttatctctctatattcatctctctctctagcttgttcacgacgccgaccacccttttccgatcccaggtaaaagtgaccaaacatggcacaaatacttgcaccttacatgcaatgtcagatgaagttttcaaaaggctccacaagttcaatgacatcaaatccttggacttcaatatttcttaaagaaaataaaaagggatcaattaaatgctctagtaagttcagagtatgtgcttctctccaatctgataatagcacagtaaacagggtggagcagctactcaacttggatgtcactccatacactgacaagataattgcagagtacatttggattggaggatctggcattgatgttcgtagcaaatcaaggacaatctctaaacctgttgagcacccatctgagcttcccaagtggaattatgatggctcaagcactggacaagcgccaggagaggacagtgaagtaatcttataccctcaagcaattttcaaggatccattccgtggtggtaataatatccttgtaatctgtgacacatacacaccagcaggcgaacccatccccactaataaaagatacagggctgcacagatatttagcgacccaaaggttgtttctgagattccatggtttggaatagagcaggaatacacgttgctccaacaaaatgttaaatggcctttgggatggcctgtgggagcctatcctggtcctcagggtccatactattgtggtgctggtgctgacaaatcttttggacgtgacatatctgatgctcattacaaagcttgcttgtatgctggcatcaacattagtggcacaaatggggaagttatgcctggccagtgggaattccaagttggcccaagtgttggtattgaagctggagatcatatctggtgtgcgagatatattcttgagagaattactgaacaagctggtgtggttctgactcttgatccaaagcctattgagggtgattggaacggtgcaggttgccataccaattacagtacaaagaccatgagagaagatggtggttatgaagcaattaagaaggcaattttgaatctttcattacgccacaaggaccatatcagtgcatatggagaaggaaatgaacgaaggctgacagggaagcacgagaccgccagcatcgacacattctcttggggtgttgccaatcgtggttgctctatccgtgtgggtcgtgacacggaaaaggcaggaaaaggttatctggaagatagacggcctgcctcaaacatggacccatacgtggtaacaggtttgctcgcagaaactacaatactttgggaaccaacacttgaggctgaggcactcgcagcccaaaaactcgctcttaatgtctaattcaatcataattcgtgccagaatatcgcatattcttgaacgagggaactctttcacgtgcccagaattcgctttttttagttttagtatcctgggtatgtgagtgttttcattcgtgacctttgcttctgatcattgtttgttttgggtgttcaagagaagaataatttgtaactgttgccttctttatttttgctcttatgaagctcaagctcggtattttagttatattccagtttaaggaatgaacttcaaaatcctttgttactcatcttcaactccattgaatatatacgct

SEQ ID NO: 48 - DNA, 1702 bp, Amaranthus thunbergii
cattattccacactccacactacccatttcattctgcttactctccatccttctttctcactcctttatctctctctctctctagctcacccttttccgaacccaggtaaaagtgatcaaacatggcacaaatacttgcaccttacatgcaatgtcagatgaagttctcaaaaggctcaacaagttcaatgacatcaaatccttggacttcaatatttcttaaagaaaataaaaagggatcaattaaatgctctagtaagttcagagtatgtgcttctctccaatctgaaaatagcacaataaacagggtggagcagctactcaacttagatgtcactccatacactgacaagataattgcagagtacatttggattggaggatctggtattgatgttcgtagcaaatcaaggacaatctctaaacctgttgagcacccatctgagcttcccaagtggaattatgatggctcaagcactggacaagcgccaggagaggacagtgaagtaatcttataccctcaagcaattttcaaggatccgttccgtggtggtaataatatccttgtaatctgtgacacatacacaccagcaggcgaacccatccccactaataaaagatacagggctgcacagatctttagcgacccaaaggttgtttctgagattccatggtttggaatagagcaggaatacacgttgctccaacaaaatgttaaatggcctttgggatggcctgttggagcctatcctggtcctcagggtccatactattgtggtgctggtgctgacaaatcttttggacgtgacatatctgatgctcattacaaagcttgcttgtatgctggcatcaacattagtggcacaaatggggaagttatgcctggccagtgggaattccaagttggcccaagtgttggtattgaagctggagatcatatctggtgtgcaagatatattcttgagagaattactgaacaagctggtgtggttctgactcttgatccaaagcctattgagggtgattggaacggtgcaggttgccataccaattacagtacaaagaccatgagagaagatggtggttatgaagcaattaagaaggcaattttgaatctatcattacgccacaaggaccatatcagtgcatatggagaaggaaatgaacgaagattgacagggaagcacgagaccgccagcatcgacactttctcttggggtgttgccaatcgtggttgctctatccgtgtgggccgtgacacagaaaaagcaggcaaaggttatctggaagacaggcggcctgcctcaaacatggacccatacgtggtaacaggtttgcttgcagaaactacaatactttgggaaccaacacttgaggctgaggcactagcagcccaaaaactcgctcttaatgtgtaattcaatcataatcgtgccagaatatcgcatattcatgaacgagggaactctttcacgtgcccagaatttgcttatttttagtttttagtatcctgggtatgtgagtgttttcattcatgacctttgcttctgatcattgtttgttttgggagttcaagagaagaataatttgtaactgttgccttcattatttttgctactccaccaattgtagaacaccatgaaaatatgactgcaacagttaagctactccgccgattcggaaaatatagattgaagtgata

SEQ ID NO: 49 - DNA, 1744 bp, Amaranthus viridis
ccattattccattctacccatacttgggacaatcatactcctctaactcctttaaccatactcattacacactctctcttctttatctctctatattcttcactctctctctagttacttgacgccgccgaccaccttttccgaacccagtgaccaattatggcacagatacttgcacctaacatgcaatgtcagatgaagttttccaaaggctcgacaagttcaatgacattaagtccttggacttccatatttctgaaagaaaaccaaaagaaatcgattaaatgctctagtaagttcagagtgtgtgcttctctcaaatctgaaaacagcactgtaaacagggtggagcagctactcaacttggatgtcactccatacactgacaagataattgcagagtacatttggattggaggatccggtattgatgtccgtagcaaatcaaggacaatctctaaacctgttgagcacccatctgagcttcccaagtggaattatgatggctcaagtacaggacaagctcccggagaggacagtgaagtaatcttataccctcaagcaattttcaaggatccattccgtggtggtaataatatccttgtaatctgtgacacatacaccccagcaggcgaacctattcccactaacaaaagatacagggctgcacagatattcagcgacccaaaggttgtttccgaggttccatggtttggaatagagcaggaatacactttgctccaacaaaatgttaaatggcctttgggatggcccgtgggagcctatcctggtcctcagggtccatactactgtggtgctggtgctgacaaatcttttggacgtgacatatctgatgctcattacaaagcttgtttgtatgccggtattaacattagtggcacaaatggggaagttatgcctggccagtgggaattccaagttggtccaagtgttggcattgaagctggagatcatatctggtgtgctagatacattctcgagagaattactgaacaagctggtgtggttctgactcttgatccaaagcctattgagggtgattggaatggtgcaggttgccatacaaactacagtacaaagaccatgagagaagatggtggttatgaagcaattaagaaggcaattttgaatctatcattacgccacaaggaccatatcagtgcatatggagaaggaaatgaacgaagattgacagggaagcacgagaccgccagcatcgacactttctcttggggtgttgccaatcgtggttgctctatccgtgtgggccgtgacacagaaaaagcaggcaaaggttatctggaagacaggcggcctgcctcaaacatggacccatacgtggtgacaggtttgctcgcagaaactacaatactttgggaaccaacacttgaggctgaggcactagcagcccaaaaactcgctcttaatgtgtaattcaaccataatcgtgccagaatatcgcatattcatgaacgagggaactctttcacgtgcccagaatttgcttattttagttttagtatcctgggtatgtgagtgttttcattcatgacctttgcttctgatcattgtttgttttgggagttcaagagaagaataatttgtaactgttgccttcattatttttgctactccgccaattgtagaacaccatgaaaatatgactgcaacagttaagctactccgccgattcggaaaatatagattgaaggtgatatttaag

SEQ ID NO: 50 - DNA, 4893 bp, Euphorbia heterophylla
aagtcactgctattctgtgctaaactagatttatacttatttacaactgatgactgctgatttagtgatttagtgatttagatcgtactttctttgttttgctcgattttcggacgtcgattcgatatatacagatttgatgaacagcattgttgccaatgatcagtagtagtaatgttgttgaaagctttcagttatagtgatatcttccatctgctagtttttttagagaaaatcagtttttgctaggaggaaaaagggaattactaaaaaaattataaatgttctttcaaaatttgagcgaagaaaataatggttattaaacactaattttgagctgaaagaatatgatcagatgcttttgtattctaatgtcttgaatcctaatatgcacctttaaaaccttttgtttttcaatgaaaaagtaaggaaaaagattatttgcattagtggcacgagtctaatctaataaccgtggtttcgtctcttctctttcaaaaattggaaaagtgttgatgtcattttctaacatttcctactaagtactaaccaaaacaaggttttctttccactaatagaattttcctttaccacatttatacagtataaaaatctctaactttagactttagagcatactatcacatcatggtgttgtcatagtatattcatattagagcaggtttagccccaagtctgaagacttgggatgaaattacctttattgtcttaagatttagatttaagattttcccatttttcttttaaaatcttagccagatctcaagttgatttcaaggctcaacttaagacttgaaacacgggacccaccctaatttaataatgtttgttttcatatagataacataaagagataaaaaaaagtaaaatatcatggtatatatttaagactaggagtcttagggctaaagtgataaagttggacaagttttatggagtttaagaataattgataacattatttttgtgggaaccactaaaaaatgatgttacacccaagttttaagacttggtgctaagcttgctgttacaaattggtttcaatcataacagttattccttatctttgactaggaatttagtccaaatcttttgttgtggtgtactggtgtcgaggatacaacatggatacctaacgggaagaaaagagtttttgcaacttatattgtctgtctgtgtttaatgttgccacttctacgggaattctggtttctgtaatccaggattaaagagctgtcagctgttgtactgtaaattgtttgtgtaatagttttaatttttgtagggaaaggaccaaatatggcccagattctcgctcctagcatgcaatgtcagttgaaattctcaaaaagctcattaagctcgctagcatcgaacacgtggacctccattttgctaaaaggaaaccaaaagagatcgcttcattgctcaactaagttcaaggtatccgctgctctcaaatctgatgatggtactatcaacagggtagagcagctactcaatttggatgtcactccatacactgacaagattattgctgaatacatatggtatagtttcccattctgattttggcatctttatcgagggttattttttctcaaatatgcttgatgaggttatggtagaatcaacatattagggctttacttgcatggttgtattaggctcttttgttgtagaaaagcctgcttggtaattcagtgtccaggtgttgatggaactaattgaattatgattgttcattggaataggattggaggatctgggattgatgttcgcagtaaatccagggtatagtaacatccattctgtagcttgattgttaaccacctattagatgctgactaatgttttcttaataataccagacaatctcaagacctattgaggatccatctgaacttcccaaatggaactttgatgggtcaagcactggacaagcgccgggagaagacagtgaagtaatcttatagtaagatcctcttacatctatgaatcttcatcattttccccataaattcattattcattatttccgagtctttcttttattcttgtcttttaatgactgatcattagtcattgttgtcttgcatttcttctgcaatagccctcaagcaatttttaaggatccttttcgtggtggtaacaatatcttggtgagtttgatagagcatatgaatcggttattctaaagttatagtatttcttataaataataaatttatttgttaaggttgcaaccataatttatgatttgtaaatctaggtgatctgtgatgcatacacaccagcaggtgaacccatcccaactaataaacgacacaaagctgcacagatcttcagcaaccaaaaggttgtttctgaggttccatggtatgaagttccttgtactgataaaatccatttatgaattgttaataaccactttgcatttgaacattaaattttgtgtacaaagtttcctattataggaaggataattaattaatcataattgggagggtgaaattgagaagaaaaaagaggattgcatgaacagtccaatgcattttgttgctgacatgagagcaatttggggctttgtagagctggctggattgtggaatgtaatcaacaggaaactgatgactgaccactgtgaatatgatctgttatgacacatttcatttttcgaatagaggaatttcattgccaggttgacctataacagtataactatgtcagaacagagcttctcgatttcaaaattgtgttggcttttttctttttcaaataatcagaagagactcatctttagttttctgtgttatcgttctactttaagcttttattactctttgttttagtcatttaatcatatttttacaggtttggaatagagcaggaatacacgcttcttcaaccaaatgttaattggcccttgggatggcctgtgggagcttatcccggtcctcaagtatgttactcagttgctcctatttcatattcattttgtccaatgaagatgctttgttgtgttatagattagaatcgttttgttacgcaaaatgatttttttcgcattttctagggtccatattattgtggtgttggtgctgaaaaatcttttggacgtgacatttctgatgctcactataaagcttgcctgtatgctggaattaacatcagtggcaccaatggggaagttatgcctggccaggtattcacttacatcattctagtatgtctaccagtcataaatttgctttgaatcttgtaactcaatagctgtatatccacttgtacctacagtgggaattccaggttggtcctagtgttgggattgaagcaggagatcatatctggtgtgccagatatattcttgaggtattctcctgcaatttgtatgtttccctctgcgcttatcagttacaactatagttttgtaatttgctgccctatcgttttattattcattatttttctacttgaattctgcttgaaagaaaataagctactttgacacagactcgaagtgaaagtgaccatatgagaatcaaactgaccttggaattatatgtgattaacaaccgaatctaatctcttatggaagacataaattaataatacttaataggctccaatgtggatgacctcccggaataatcacttttggttcatgttagccgacccctcatatgtgattaaggctttgattgattgattgaataggctccaatgtgacccaaactcaccaagggtaaataaatgctattttacctgtattgtatggctaactatggctaaccagatataaccataactgaattgttaaactgaataatttaagaatcataagtagctttataatgtagggacattggggtgactcatgacgagggagtgaggcacaaatgaaataggtctaaaatgaactattgatgaatatttaagtttgcaattgaagatccacattatcatctaattgtaaaacataattgctaatgctcaacagaacctagtcctttaagtagaagccaaattcattagaagtttagcacattgtgaaaccttgatccatatcaatatatgtaggctgaagaaattacagctcaaattttgttattagttgtagctttagtgttgagttaagtataaactataaagatgggcactcaactttagacaaaatcgcaatttgagcactcaactttagacaaaattgcaatttgagcactcaactttgaaaagttgcaagttgattactaattttggttaactatagttctaccctcctccatccttaaatctcttgctactagtccagcaccacaatcaaaatcctagcagtcatgctaccaatttgccactgaccattcaatccactagagaaccccccaaaaagcaccatgcaccagtgcaccaccacccaaaaaaatcacgggtcaccacgatggaaccaactattaagaaaaaacccaccattaccaccattaaatttgaaccaactattaaagaattgcttaatttgtacacaatgatcataaaaaaaaagtttgcaccccattcaatagaagtgaagaatgttatacggagtacaatgaatcaaacataaaattcagccaattgacaattacaatttcttcaaagctgccataaatgaaaaaccatactcactatcaaatttgaaagaaaaccatcaaattcaaacccataattagaagtaaaagtgttgggtaaagcgggtttccgttaacattaatgaaaacgatctaatatactgtaattttgatagtatttttttgtgtaactttaacatttttattgtaacctggatggttgagggttgaagatttggaatgtcgaattaacttggatgaacaatgg

SEQ ID NO: 51 - DNA, 1581 bp, Sorghum halepense
ccacaagtgtggtacggccattattggaggattacacaagaagaagaaggtaggaggagatcacccaagcggacggacggcatggaatggaagtgggaagcgtcaaagtttttatgtgttttgttttggcacaccacgacctgacccaaattctagctaaattgcagtagtagagtagtataagcaaacggaacgggaaggaacaattgttgcgcaaatcgctggacgggaccctgcaatgcaacggccggacactgccgcggaacaaaccgacacgacaaacggcgagctggatggaggaaaccttccgcttcagggcttccagaggatggtggtgtcggcgatcatggaggtcaccacgtatgggtccatgttggacgccggccggcggtcctcgaagtagcccttgccgttctgctccgtctcccggcccacgcgcactgacgcgccacggtttgccactccccagctgaaggtgttgatgtcggcggtctcgtgcctgccggtgaggcggcgctcgttgccctcgccgtaggccgcgatgtgctccttgtgccgcagcttcagcttctcgatggcggccttgatcacctcgtacccgccctcgttcctcatggacttggtgctgtagttggtgtgtgcgccggcaccgttccagtcaccagggatgggctttgggtcgaatgtcaacaccacaccggcgatctcggtgatcctctcaagaatgtagcgagcaacccagacctgatcgcctgaagaaatgccgacggacggtccaacttggaattcccactgccctggcatgacctctccgttgatgccactgatgttgatgcctgcataaatgcaagccttgtagtgggcatcaactatatcacgcccgaatgacttgtccgcaccaactccacagtagtacggaccctgagggccagggaagccaccaagaggccacccaaggggccagttggtgtccttctgaaggagggtgtactcctgctcaataccgtaccagggctcctcagcggcgacctcagggttgctgaagatcttggcggcgttgtgcctcttgttggtgggaattggctcgccagctggggtgtagcaatcgcacatgacaaggatgttgttgcccctccggaatgggtccttgaagatagcctgcgggtacaggatgacctcactgtcctcgccgggggcctggccggtgctggagccgtcgtagttccacttgggcagcttgctgggatcggtcaccgggccggagagggtcctggctttgctcctgagatccatgccagatccaccgatccatatgtactcggcgatgatcttctcggtggtgtccgagaggctgaggttgacgaggtcggtgagggaggccatggccggcggcggctgggaaggacccaaaggaggaagaagagggaggaggtggtggtagcgatcaagaacttctctggttttgttgaggctgacaaggatggaaattggtcttgtccaactgacaagaagcgtaagcaagagatatttccgaaccctgtattagaagttaacagactagttgctagtcttcaatcgtac

SEQ ID NO: 52 - DNA, 710 bp, Convulvulus arvensis
aagaatatactctccttcaaaaagatgttaattggccacttgggtggcctgctggaggttatcctggtccacagggaccatactactgtggaattggagccgataaggcttttgggcgtgacattgtcgactcgcactataaggcctgcctttacgcggggattaacatcagcggtatcaatggcgaagtgatgcctggacagtgggaattccaagttggaccggctgttggcatctcagctggcgatgaggtgtgggtagctcgctatattctcgagaggatttctgagattgctggagttgttgtctcattcgaccccaaacctatcccgggtgattggaatggtgctggagctcacacaaactacagcactaagtcaatgaggaatgagggtggatttgaagtcatcaagaaggcaattgcaaagcttcaggtgaggcacaaggagcacattgctgcatatggtgagggcaacgagcgccgcttgaccggaaaacacgagacagctgacatcaacaccttctcatggggagttgcgaataggggtgcatcggttcgtgtgggccgggacacggagaaagatggcaagggttactttgaggaccgaaggccggcttcgaacatggatccctacactgtgacctccatgattgcagagaccaccatcctgaacaaagattgagctgtttcttggtgggatgtgtttgga

SEQ ID NO: 53 - DNA, 1276 bp, Chenopodium album
tcatattctgaaagtctcataaaaagagaaagatctctttattattttccaatcaatcaaccaaattgtttcatccaaatcccaaaaaaaatatgtcgcttctttcagatcttgttaacattaatctctcagactccactgataaggtcattgctgagtacatatggattggtggatctggtatggacatgagaagtaaagcaagaacactcaatggaccagtttctgatccaaaagagttgccaaaatggaattatgatggatctagcactggtcaagctcctggtgaagacagtgaagtcattctctacccacaagctatcttcaaagatccattcaggaggggcaacaatattcttgtcatgtgcgacgcatatacccctcaaggagaaccaatccccaccaacaagagacacgatgctgcaaagatattcagccatccaggtgtagctgctgagtgccttggtatggtatcgagcaggagtacaccttgctgcaaaaggacgttaattggcccattggctggcctgtcggaggttttcctggtccacagggcccctactactgtggtattggtgctgataaagcttttggaagggacattgttgattcacactacaaggcttgcctttatgcaggaattaacattagtggaatcaatggagaagtgatgccaggacagtgggaattccaagtcggtccatcagttggaatctctgctggagatgagttatgggtagctcgttacattttggagaggattactgagattgctggagtggctctttcttttgatccaaagccaattccaggtgattggaacggtgctggtgctcacacaaactacagcacaaagtccatgagggaagatggtggctatgaaatcattaaacaagctattgaaaagcttggattaaggcacaaggaacacattgctgcttatggtgaaggaaatgaacgccgtctcactggtaaacacgaaacagccagcatttcaaccttcttgtggggagtagccaaccgaggtgcatcagttcgtgttggacgagacactgaaaaggagggaaaaggatatttcgaggacaggaggccggcttctaacatggacccttacgttgtcacttccatgattgcagaaaccactattctttggaaaccatagagtccaagcttcaatctttaaccaccctttctatattaagtcatttgctttaaatcagcagctgtctactcaagctgttaggatttttcgattttctatacataatggccattg

SEQ ID NO: 54 - DNA, 671 bp, Ambrosia artemisiifolia
tttaacaatttaatacatttttgttgtgaaaagatttgatctttatgttttatttgttgcagggcgttgcaaaccgtggagcatctattcgggtcgggagggacactgagaaagaggggaaagggtactttgaggaccgaaggccggcttctaacatggatccatatgtggtgacctccatgattgctgagaccaccatcttgtggaacaaatcttgaagataacaagatttggatgatgacattatgaagcctgatatggagggagattgaaaaaagtaactggaatttggaaacaacccttctatatgtactttgttaaaatttaggtgcatcctactctgtttgcttgtttatttttacttgatgtttcatatgttctttataatggaaagcattttgagtccaaaatgctaatggtagctacttgatttgatttgagattttcccattgggaatattgtcaatatgtctattttgaataacaatatggaggggttgattcctatttgtgtttgtgtttttgtttgcttgacatgcattcattatactcattaagtacataaaatttaagaaaattttctaaaagcatcattcaatcatattctttatccttataccctattcatatatttatttgaaaactaaagtgagttcttatattaaagaaat

SEQ ID NO: 55 - DNA, 3047 bp, Euphorbia heterophylla
aacaattaatcaatcatatttgcgtaactttttaataaggaatgtaggtatagatttcgagaaaatccaaagctcgatataagttttaattgtcactcaccacccaccttttttttgaaaatatataaattaaaacataaacggaattatcggttaatgaaatataattgtatatactaaccgaaaaaataattgtgagatgagtaaataacttatattgtgttatttgatttttgcactttgtgtatgaatttgcgggtaataacaatttatttaatcaaatactatcgtttattttatgataaaaaatatacagatatttttaattttgtttattttgtctaaattatttattttgtctaaattaataccacagatcatttaattggcctcgctaaattatgaataaataatgatgaccaagtgtccaagtacacaagcttgttttcatcatagttgttggcttgttccaacttgcaattgtcgcttagcttatcccactacacaacaattgaaggctaaaaatgctcattagcttatgtcatgcaccaaatatggggtcatgtgcaccatatgatgcactctatgcaaacataccctattcatttagtgcgcgttttttttcaccttattaaacccgaacttaaattcaaactaaacttaatgtttattaccccaatgtttcaggtatggcattgagcaagaatacacactccttcagaaggaggtcaactggcctcttggttggccagttggtggcttccctggtcctcaggtgcgctatcaaaaccaaactttcttcatttgttactcttttcgtatacatttattttcttatactttcgcgctgttttgcaactgatctaaaactttttgtgtgattgtctttggcgggtgcagggtccatactactgtggtgtaggggctgataaatcgtttggccgtgacattgtggatgctcactacaaggcttgcctgtatgccggtatcaatatcagtggaatcaacggtgaagtcatgccaggacaggtatgaaactatgaatgcatagtgtctattcagttggtttcgacagctgatccataacacaacaatagtttcacactaatagtggattcgatgatctgatcaacattgcttgcttgatcttttttcgtgcagtgggaattccaagtcggacctactgttggaatttcttctggtgatcaagtctgggttgccagatacatcctagaggtaatctgttagtccttttctgctctacttattgttcgtgtttctcgcgtcttgcattctttggctatctcggtgtctgacccaatgctcgctctcatctacagaggattgcagagattgctggagtagttgttactttcgaccctaaaccagtgaaggtctgcctaatataccaatctttttttctgtgaaaatttatgcaagagaatatcagttatcatgaaccaaatatacttttcttaatttttgtctgtttatttcaaaaaacatcagggtgactggaacggtgctggtgctcacactaactacaggtaattactccctccattccgttttatatgatcgcttgattaatcgtcaatgaggaatacttgaattacctgatttactaatgcaatacttgaatttattatctacgagtcttcttcaatgccaattttatcagggttttgtttgcttaattgttcatgcagcactaagtcaatgaggaacgatggtggaatcgatgtgatcaagaaagcaatcgagaagttgagcctgcgccataaggaacacatttccgcctatggtgagggtaatgagaggaggctcactggtcgccatgagacagccgacatcaacactttctcctgggtaaacttcgttatacttcaactaactgttattaagcattagctagttttctaacaagagaccgattaatcttgtttaatcttactgttctatgtataatgtatgttcattagatttgtgtaagctgtttcttgtatcgtacgactaataatttgatacgtaactaattggaattcagggagtggcgaatagaggtgcttctgttcgtgttggtcgcgacacagagaaagatggcaaaggttaggaattctgtttaatcttttcttttctgcttaacgtttgtttatgttcttctcaagtgcttttatttcgcccacattatttggcttaagcttaaatcacgaattttatactccgtaccacataggtacatatatatagatatagattatagcggaatgagagtaaacactgtaatatatagttcgagttttgaaccttttatttgaatctaacgcgtatattttttgttacgttaataggttacttcgaagaccgaaggccggcatcaaacatggatccctatgtcgtgacctccatgattgccgagacaactatcctatggaagccttgattggagaatctgaacgaatttgcattgtttagacatttcaacgaacccacatcatgtttatgtgcatttgaataatcatacattgatgtcgtatttgggactagaattcctaaaatgcttgacatatcgtttggttgatcatttgtgagtagtgtaacgtgtactccttttcatctcatgcaagtgaattgttcttttaagttggattttgtttaccaaattgtgattggttgtttttatttattataattcttgcatttgattgaattagaatctattccgaaatttgcaactttcaatcgatttaacaaaaacatacactaatcgtaatctaaagacaaaattagggcaaaatcaaggggtttttctaaggtatacccttgaagttttgggttttccaaggtctacttatgccttttgaaactttcaagggatacccctgaactcaatacacattattattcatatcctcccctagttaaaacactcaccttagaataaaataaaaaataaaaacaaaataaattaaaaagccctaaatctcctccttcctccctcaccaccatccactcaccactgccaactgcagccaaccgttggacca

SEQ ID NO: 56 - DNA, 2153 bp, Euphorbia heterophylla
caaaagcactttatcttttcattgtattttccttttgggttggaaagagcattttaaagttaagctgaataaaggctacaaagttgcacattcaaactatcctaggaaatggcaaagatatgctttacgtataaactctgcataaattgttgttcacatgtagaagagggctttcgtttttgtagtttgctatagaatgaatgggaagaggtctttgggacttctttttgtttccaatttcttcctattctaggtgttttgttgatataatgttcgttttccattaatttgttattgtgcagttgataaataaataaaattgtgcttcttatttataagaatgtatcccactgacctttctttctactacctctaaacatactgggcttatatgttttcctcgtcaggggtaatggcgaagagatggttttgtcagacatgcatgttaaacctggtgaaccttgggaatattgcccgagggaggcattaaggagggctgcaaaagtgctgaaagaagaattcaatttggtatctttgtaatgcctaaaatgtttcaataacttagttctatctatttttatatctgactgtttcgtgttgcatgtttaggaattggattcaggctttgagaatgaattttatctcttgaaacctatcacaaggtgattagattgaaccctgttttttcttttcattttcctttgattagtatctgattgctggttaattatagggatggaagagaagaatgggttccatttgattcgagcccatattgttcaacttcatcttttgatgcagcttctcccatccttcaggaaatgttcggtgcactgcagtctctagatattacaatggaacaggtagggagtgaataatatttattgttggcctctgtatgttactttgagaagacaaaaatattctactgtcacctgacctctatatgtatctttataagcttaattgtctagagaattttatcttgataaccatcggtggacctatgttgtaccacagtgatgcacgtgctacacgtaaaaaattaaaaatatattggtgaaatggtcaactaaaattatataaaatattagaaccctaattaatttataccatatcttataaaataaaaataaaaaatatattcaaatgttactttatacatattttcatttaaattcatgtattcacacaacctcagataatttaatttgtattttgtaatttaatgctacaattaatatatatattccctccgttccatattgttctgtgcacttttcccatttggacgttccataatgatttgtgcattgtgctttatttcatttttagacatgcctttattattttttaatagggtggacctaccactttctccatttacacattctctctccaatctatttttgctttttgacccaacttctattataatatgttattcttactttttccccaaatagtaaatgcacaaaacaatatggaacggagggagtacaataatatgtaagttattttagttgatactacacttgatataatatataatatctatttttggtgattcgatgtgggtgaggttaaacactaaattatttgtacatattatgtacaaatacaacttaacacaataatttgtatttaagaataatttaccaagaggtttctgatgattagtattgctttcctattcattcttaagcgttccttgaaatcacttgtagccgaaagctgtctttacaatcctatttcatcatagagtttctgattttctaactactgctgaatgcgaagaattttgtaactacattgctgaatgcgaagaattttgtaactacattgctgaatgcgatgaattttgtaaactacattcttagcaatgcatgttaaatgattatttgacatggacaaaataagtgtaacaatagcaagttgatcgccgattgtgacataattaattaatcaaattcaaaagctctcaattttttttattgcaggatattatttgaaaagctatttaaattcttgttttggctcacttatatacaaccaaatgctctttctctcgatgtgaattagaaatcttattttcttcattggtttggcgccacacctattgtcagtccctctatatgcttattacttgtgtt

SEQ ID NO: 57 - DNA, 946 bp, Euphorbia heterophylla
aatatgcgtgaaaagtacaattattaataatttgtccaataaatattttgttgttaaagattttaagaggttgaaaaagtagtatattttttggttgaaaaagaatggagaataaacaatatcaaaacaataaataaagcagtatctaaaagtagagtgtaatttgtgtagtccactctttaaaagagtaccaaaagttgaggacttcctcatcataccattttatattggttgtttcagacatcactctatatattaggcgtcattttgcgattcatttcacgcatttcttgatcacattctcacaatatctttcgttctctcaatattttccataaacaatattcacaacaacaacatgtcgcttctctcagatctcattaaccttgatctttctgattctactgataagatcattgctgagtacatatggtcagttctttattattgcacaccatcttttcgattttattacccaatgaataaagttttattttttctgggtttttctcttttagcagaaagatttcattaacaacttaattcacaatgaaggatttcagcttttttagttatgaatagtttgatgaagaaaagtgatgggttgtatcttatatattttatctgtttgttcttaatatgggatattttccagtgttacaatattgcttatttgactagcaaaagatatttatcttatttttcattgaacaaaatatgcacataatgattttcttttattggaagtcatagtgtagtaatcaagaacttgctgtgaatttattttcaggattggtggatctggtatggacatgagaagtaaagctagagtgtagtttttttttctttttttgtttattgtattatttttaaccttaaaccttcacctaccaaaatgaatgaataaataaataaataaatttttagtttattattacgtaagtac

SEQ ID NO: 58 - DNA, 375 bp, Euphorbia heterophylla
ttttgttggttggaaggaatgttttctagcttctatttcgctttcgtatggtaacttattactttaaataaaggacaagaaaatgatttttgattttggaaagtatcgagaaatgttttttgaaagctattttcttatgaatatactaaaaatgtgatctaatctttattaaataatgccatacttgtccactgaaaatatatttatttgggggtcaactgttaattaattcttgatcatggttgtaacagcccacaagctatcttcagagatccattcaggaggggaaacaatatccttgtgagtttcgttgttacctatttcgttcgtgacatctgttagcatcattggctgttagtaggctaattcagtaat

SEQ ID NO: 59 - DNA, 459 bp, Euphorbia heterophylla
aaaagttaatagagagtgagggatagctcaagtggttaaagcttccttctcgaggtgatcctgtgatcgattctcatcccgcccttgtatatatatataacagaggatctacaaatgattactctaactgcaacttatctcattttgcaactttcaataaactttagtactttccattaccttaactcctttagtgttatggatttgttaacaaactccttgatttactttaacaagttaatttccctttaaacagagaattactgaacaagctggtgtagttttgactcttgatccaaagcccatcgaggtactaataacttttcttttgtattagtaatacgaatttttcatgtgttatccgtctgaaatctttgcaactcgtcaacagggtgactggaatggtgcaggttgccataccaattacaggtatcttcttgaagaatttagtatttattc

SEQ ID NO: 60 - DNA, 200 bp, Abutilon theophrasti
aattttcaatctgttgtctagtttgttttatcttatgttcttttggacgttcttccaaccttcagacaatagcaaagccagttgagcatccctctgaacttcccaagtggaactatgatggatcaagcaccggtcaagcacctggtgatgacagtgaagttattttatagtaagatctttaatgaaaactaaaacttcct

SEQ ID NO: 61 - DNA, 200 bp, Abutilon theophrasti
aggaagttttagttttcattaaagatcttactataaaataacttcactgtcatcaccaggtgcttgaccggtgcttgatccatcatagttccacttgggaagttcagagggatgctcaactggctttgctattgtctgaaggttggaagaacgtccaaaagaacataagataaaacaaactagacaacagattgaaaatt

SEQ ID NO: 62 - DNA, 200 bp, Abutilon theophrasti
tctttaatgaaaactaaaacttcctttattgcttgttttcatcaaaacactatttgactgaaaattttatccagccctcaggcaatctttaaggaccctttccgaggaggtaacaatatcttggtgagtattaacaaaggcttataattgaaaatttctgatgaattgttgaaatttttgtgggtaaattatatagtgtg

SEQ ID NO: 63 - DNA, 200 bp, Abutilon theophrasti
cacactatataatttacccacaaaaatttcaacaattcatcagaaattttcaattataagcctttgttaatactcaccaagatattgttacctcctcggaaagggtccttaaagattgcctgagggctggataaaattttcagtcaaatagtgttttgatgaaaacaagcaataaaggaagttttagttttcattaaaga

SEQ ID NO: 64 - DNA, 200 bp, Abutilon theophrasti
ttttgtgggtaaattatatagtgtggttaacattttcatgcatgtttcccataggttatttgtgatgcatacacaccggctggtgagcccattccaacgaacaagcgccacaaagctgccgagattttcagtaacaagaaggtgatagatgaaataccatggtacgaattactttattgtaactatcttattcttttgtt

SEQ ID NO: 65 - DNA, 200 bp, Abutilon theophrasti
aacaaaagaataagatagttacaataaagtaattcgtaccatggtatttcatctatcaccttcttgttactgaaaatctcggcagctttgtggcgcttgttcgttggaatgggctcaccagccggtgtgtatgcatcacaaataacctatgggaaacatgcatgaaaatgttaaccacactatataatttacccacaaaa

SEQ ID NO: 66 - DNA, 200 bp, Abutilon theophrasti
attgtaactatcttattcttttgttcaaatctggattaattgagaattatattgtaatcttgtgttcgctttattctatctcggcattcatacaaaaggaaatgccctcattttgttgtactattctgttaaggtttgggattgagcaagagtacaccttacttcaacaaaatgtaaaatggcctttgggttggcctgtt

SEQ ID NO: 67 - DNA, 200 bp, Abutilon theophrasti
aacaggccaacccaaaggccattttacattttgttgaagtaaggtgtactcttgctcaatcccaaaccttaacagaatagtacaacaaaatgagggcatttccttttgtatgaatgccgagatagaataaagcgaacacaagattacaatataattctcaattaatccagatttgaacaaaagaataagatagttacaat

SEQ ID NO: 68 - DNA, 200 bp, Abutilon theophrasti
aaaatggcctttgggttggcctgttggaggctaccccggtcctcaggtaataatatgactcgatttttatacaggagtaaattggttgtagggggtctgtaaattcttgctaataacatagtcctacttgaacttatacttgaatgtggttgtttgatgccaaattcagggtccttattactgtggagctggagctgaca

SEQ ID NO: 69 - DNA, 200 bp, Abutilon theophrasti
tgtcagctccagctccacagtaataaggaccctgaatttggcatcaaacaaccacattcaagtataagttcaagtaggactatgttattagcaagaatttacagaccccctacaaccaatttactcctgtataaaaatcgagtcatattattacctgaggaccggggtagcctccaacaggccaacccaaaggccatttt

SEQ ID NO: 70 - DNA, 200 bp, Abutilon theophrasti
tattactgtggagctggagctgacaagtcattcgggcgtgacatctcagatgctcattacaaggcttgcttatatgctggcatcaacattagtggcacccaatggggaggttatgcccggccaggtctgctgcctttgagtcctcatcttgctaatgaaaatgaagtgctattgcagtcatgtttgtttgtgtattaggt

SEQ ID NO: 71 - DNA, 200 bp, Abutilon theophrasti
acctaatacacaaacaaacatgactgcaatagcacttcattttcattagcaagatgaggactcaaaggcagcagacctggccgggcataacctccccattgggtgccactaatgttgatgccagcatataagcaagccttgtaatgagcatctgagatgtcacgcccgaatgacttgtcagctccagctccacagtaata

SEQ ID NO: 72 - DNA, 200 bp, Abutilon theophrasti
agtcatgtttgtttgtgtattaggtatcaccatttgattctgtaaattactatgcagtgggagtatcaagttggtccaagtgttggtattgaggctggagatcatatctggtgttctagatacattcttgaggtatttattctcacatgatttggttaatcttatggaggccgctgcaaaattccagccttcgcacacat

SEQ ID NO: 73 - DNA, 200 bp, Abutilon theophrasti
atgtgtgcgaaggctggaattttgcagcggcctccataagattaaccaaatcatgtgagaataaatacctcaagaatgtatctagaacaccagatatgatctccagcctcaataccaacacttggaccaacttgatactcccactgcatagtaatttacagaatcaaatggtgatacctaatacacaaacaaacatgact

SEQ ID NO: 74 - DNA, 200 bp, Abutilon theophrasti
gtatggatggctcgatacatactcgaggtatgatctgtatactatagtgtatttgattaatgaatttttacctctttaaggattgaagtttaactaataaacttctgtttttcttgttttaaacagcgaatcaccgaaattgcaggagtggttctttctttttgtatcccaaacccattccggtttgtttttctatgcta

SEQ ID NO: 75 - DNA, 200 bp, Abutilon theophrasti
tagcatagaaaaacaaaccggaatgggtttgggatacaaaaagaaagaaccactcctgcaatttcggtgattcgctgtttaaaacaagaaaaacagaagtttattagttaaacttcaatccttaaagaggtaaaaattcattaatcaaatacactatagtatacagatcatacctcgagtatgtatcgagccatccatac

SEQ ID NO: 76 - DNA, 200 bp, Abutilon theophrasti
cattccggtttgtttttctatgctacattttctcctatattcaactttatatcgccttttatgttctttttccccttttttctcgtcctgcctctttaacttttcatctttgcatttcatttcgataactagggtgactggaatggtgctggtgctcataccaactacaggtagatactaaactcattgtgcacttcact

SEQ ID NO: 77 - DNA, 200 bp, Abutilon theophrasti
agtgaagtgcacaatgagtttagtatctacctgtagttggtatgagcaccagcaccattccagtcaccctagttatcgaaatgaaatgcaaagatgaaaagttaaagaggcaggacgagaaaaaaggggaaaaagaacataaaaggcgatataaagttgaatataggagaaaatgtagcatagaaaaacaaaccggaatg

SEQ ID NO: 78 - DNA, 200 bp, Abutilon theophrasti
tactaaactcattgtgcacttcacttttataaagtatataatatatacccttttgcatggatgaagagttaattagttgaattgaaactctctcagcacaaagtccatgagaaatgatggcggcatcaaagttatcaaggaggcgattgagaagttgggtaagcgccacaaggagcacattgccgcctacggtgagggta

SEQ ID NO: 79 - DNA, 200 bp, Abutilon theophrasti
taccctcaccgtaggcggcaatgtgctccttgtggcgcttacccaacttctcaatcgcctccttgataactttgatgccgccatcatttctcatggactttgtgctgagagagtttcaattcaactaattaactcttcatccatgcaaaagggtatatattatatactttataaaagtgaagtgcacaatgagtttagta

SEQ ID NO: 80 - DNA, 200 bp, Abutilon theophrasti
cacattgccgcctacggtgagggtaacgagagacgcttaactggtcgtcacgagactgctgatatcaacacattctcttgggtaagtttgaacaattgtaggcctatagcatcccctttccaacaagctagaatggtattgaattctcttatggttaaacatctccattttctaatttcttgttgctgttttgattgcca

SEQ ID NO: 81 - DNA, 200 bp, Abutilon theophrasti
tggcaatcaaaacagcaacaagaaattagaaaatggagatgtttaaccataagagaattcaataccattctagcttgttggaaaggggatgctataggcctacaattgttcaaacttacccaagagaatgtgttgatatcagcagtctcgtgacgaccagttaagcgtctctcgttaccctcaccgtaggcggcaatgtg

SEQ ID NO: 82 - DNA, 200 bp, Abutilon theophrasti
tttcttgttgctgttttgattgccatgtccaaactccagggtgtggcaaacaggggagcctccatccgtgttggccgtgacaccgataaggacggaaaaggttagcactatgcagatattgatcaaacttcgattctaatatgaacctccatttttttctcattccttgaattttaacattcatggtcatgtaattcgca

SEQ ID NO: 83 - DNA, 200 bp, Abutilon theophrasti
tgcgaattacatgaccatgaatgttaaaattcaaggaatgagaaaaaaatggaggttcatattagaatcgaagtttgatcaatatctgcatagtgctaaccttttccgtccttatcggtgtcacggccaacacggatggaggctcccctgtttgccacaccctggagtttggacatggcaatcaaaacagcaacaagaaa

SEQ ID NO: 84 - DNA, 200 bp, Abutilon theophrasti
aacattcatggtcatgtaattcgcaggctacttcgaagacagaaggccggcatcaaacatggatccttatgtcgtgacatcgatgattgccgagaccaccattatatggaagccttgagaggttaaaattggagcttgcggatgatgagaaagaaaatcctccattcatattaaaaaacccctctctcatcttctttgtt

SEQ ID NO: 85 - DNA, 200 bp, Abutilon theophrasti
aacaaagaagatgagagaggggttttttaatatgaatggaggattttctttctcatcatccgcaagctccaattttaacctctcaaggcttccatataatggtggtctcggcaatcatcgatgtcacgacataaggatccatgtttgatgccggccttctgtcttcgaagtagcctgcgaattacatgaccatgaatgtt

SEQ ID NO: 86 - DNA, 200 bp, Abutilon theophrasti
tggatggcctcttggtggctatcctggacctcaggtactcccatctttctttctttcaaaagcaatgtttaaatgttggatgatatatatatcggactggacggagagccgatttgttcaaccaatcggtgaatatgtaaccctgattcgggtgaatattttgttgatagggtccctactattgtggtgttggtgtggac

SEQ ID NO: 87 - DNA, 200 bp, Abutilon theophrasti
gtccacaccaacaccacaatagtagggaccctatcaacaaaatattcacccgaatcagggttacatattcaccgattggttgaacaaatcggctctccgtccagtccgatatatatatcatccaacatttaaacattgcttttgaaagaaagaaagatgggagtacctgaggtccaggatagccaccaagaggccatcca

SEQ ID NO: 88 - DNA, 200 bp, Abutilon theophrasti
ctactattgtggtgttggtgtggacaaagcctatgggcgtgacattgtggattctcactacaaagcttgtttatatgctggaatcaatatcagtggcatcaatggagaagtgatgccagggcaggtaaaaatgactggttttttactcttttatgcttctctcggttattggttatgttaaagcttaatctatcttctat

SEQ ID NO: 89 - DNA, 200 bp, Abutilon theophrasti
atagaagatagattaagctttaacataaccaataaccgagagaagcataaaagagtaaaaaaccagtcatttttacctgccctggcatcacttctccattgatgccactgatattgattccagcatataaacaagctttgtagtgagaatccacaatgtcacgcccataggctttgtccacaccaacaccacaatagtag

SEQ ID NO: 90 - DNA, 200 bp, Abutilon theophrasti
tgttaaagcttaatctatcttctattttctttacagtgggaatttcaggtcggtccatcacttggcatctctgctggagacgaattgtgggttgcacgttacattttggaggtaatcaacctatgttactctcgaacttgagtgtcgtagtttttaaaggttcttcatgtgtttggttatccttggtcatatctatcaac

SEQ ID NO: 91 - DNA, 200 bp, Abutilon theophrasti
gttgatagatatgaccaaggataaccaaacacatgaagaacctttaaaaactacgacactcaagttcgagagtaacataggttgattacctccaaaatgtaacgtgcaacccacaattcgtctccagcagagatgccaagtgatggaccgacctgaaattcccactgtaaagaaaatagaagatagattaagctttaaca

SEQ ID NO: 92 - DNA, 200 bp, Abutilon theophrasti
gttatccttggtcatatctatcaaccccacatatactcgaacaagaatgaaaaatcgaagcaacatagttatcgagggtttcacttcgactctcttcagttattttaatctatgtttctgaaatacagaggattaccgagattgctggagtggtgctctcctttgatcctaagccaattcaggttcgaattgctggttcc

SEQ ID NO: 93 - DNA, 200 bp, Abutilon theophrasti
ggaaccagcaattcgaacctgaattggcttaggatcaaaggagagcaccactccagcaatctcggtaatcctctgtatttcagaaacatagattaaaataactgaagagagtcgaagtgaaaccctcgataactatgttgcttcgatttttcattcttgttcgagtatatgtggggttgatagatatgaccaaggataac

SEQ ID NO: 94 - DNA, 200 bp, Abutilon theophrasti
ttttcccctctctttcttcttagtttcgctgttgttcaatatgttgctcctcaatgatctcatcaacctcgacctcaccgagaccaccgagaagatcatagccgaatacatatggatcggtggatctggtatggatttgagaagcaaagcaagaactttgcctggaccggtgtcggaccctgcaaaacttccgaaatgga

SEQ ID NO: 95 - DNA, 200 bp, Abutilon theophrasti
tccatttcggaagttttgcagggtccgacaccggtccaggcaaagttcttgctttgcttctcaaatccataccagatccaccgatccatatgtattcggctatgatcttctcggtggtctcggtgaggtcgaggttgatgagatcattgaggagcaacatattgaacaacagcgaaactaagaagaaagagaggggaaaa

SEQ ID NO: 96 - DNA, 200 bp, Abutilon theophrasti
gaccctgcaaaacttccgaaatggaactacgatggttcaagcacaaatcaagctcctggagacgatagtgaagtgattctatatcctcaagctatattcaaggatccattcagaagaggaaacaacatcttggtgatgtgcgatgcttacacaccagccggtgagcccattcccacgaacaagagatataatgcagccaa

SEQ ID NO: 97 - DNA, 200 bp, Abutilon theophrasti
ttggctgcattatatctcttgttcgtgggaatgggctcaccggctggtgtgtaagcatcgcacatcaccaagatgttgtttcctcttctgaatggatccttgaatatagcttgaggatatagaatcacttcactatcgtctccaggagcttgatttgtgcttgaaccatcgtagttccatttcggaagttttgcagggtc

SEQ ID NO: 98 - DNA, 200 bp, Abutilon theophrasti
cgaacaagagatataatgcagccaagatatttagcaaccctgatgttgttgccgaggaaccatggtatggcattgagcaagagtacactcttcttcaaaaggataccaagtggcctcttggatggcctgttggaggatttccaggaccacagggcccctactactgtggagtaggagctgacaagtcctttggcagggac

SEQ ID NO: 99 - DNA, 200 bp, Abutilon theophrasti
gtccctgccaaaggacttgtcagctcctactccacagtagtaggggccctgtggtcctggaaatcctccaacaggccatccaagaggccacttggtatccttttgaagaagagtgtactcttgctcaatgccataccatggttcctcggcaacaacatcagggttgctaaatatcttggctgcattatatctcttgttcg

SEQ ID NO: 100 - DNA, 200 bp, Abutilon theophrasti
agctgacaagtcctttggcagggacattgtggattcccactacaaggcttgcctttatgctggcattaacatcagtggaatcaacggtgaagttatgcccggtcaatgggagttccaagttggtccagcggttggaatatctgcgggtgatcaagtatggatggctcgatacatactcgagcgaatcaccgaaattgcag

SEQ ID NO: 101 - DNA, 200 bp, Abutilon theophrasti
ctgcaatttcggtgattcgctcgagtatgtatcgagccatccatacttgatcacccgcagatattccaaccgctggaccaacttggaactcccattgaccgggcataacttcaccgttgattccactgatgttaatgccagcataaaggcaagccttgtagtgggaatccacaatgtccctgccaaaggacttgtcagct

SEQ ID NO: 102 - DNA, 200 bp, Abutilon theophrasti
ctcgagcgaatcaccgaaattgcaggagtggttctttctttcgatcccaaacccattccgggtgactggaatggtgctggtgctcataccaactacagcacaaagtccatgagaaatgatggcggcatcaaagttatcaaggaggcgattgagaagttgggtaagcgccacaaggagcacattgccgcctacggtgaggg

SEQ ID NO: 103 - DNA, 200 bp, Abutilon theophrasti
ccctcaccgtaggcggcaatgtgctccttgtggcgcttacccaacttctcaatcgcctccttgataactttgatgccgccatcatttctcatggactttgtgctgtagttggtatgagcaccagcaccattccagtcacccggaatgggtttgggatcgaaagaaagaaccactcctgcaatttcggtgattcgctcgag

SEQ ID NO: 104 - DNA, 200 bp, Abutilon theophrasti
agcacattgccgcctacggtgagggtaacgagagacgcttaactggtcgtcacgagactgctgatatcaacacattctcttggggtgtggcaaacaggggagcctccatccgtgttggccgtgacaccgataaggacggaaaaggctacttcgaagacagaaggccggcatcaaacatggatccttatgtcgtgacatcg

SEQ ID NO: 105 - DNA, 200 bp, Abutilon theophrasti
cgatgtcacgacataaggatccatgtttgatgccggccttctgtcttcgaagtagccttttccgtccttatcggtgtcacggccaacacggatggaggctcccctgtttgccacaccccaagagaatgtgttgatatcagcagtctcgtgacgaccagttaagcgtctctcgttaccctcaccgtaggcggcaatgtgct

SEQ ID NO: 106 - DNA, 200 bp, Abutilon theophrasti
catggatccttatgtcgtgacatcgatgattgccgagaccaccattatatggaagccttgagaggtgaaaattggagcttgcggatgatgagaaagaaaatcctacattcatattaataaccccttctctcatcttctttgttgtgccagtggttgaacttgtagttttattgctttggatttgctggtttgccattaaa

SEQ ID NO: 107 - DNA, 200 bp, Abutilon theophrasti
tttaatggcaaaccagcaaatccaaagcaataaaactacaagttcaaccactggcacaacaaagaagatgagagaaggggttattaatatgaatgtaggattttctttctcatcatccgcaagctccaattttcacctctcaaggcttccatataatggtggtctcggcaatcatcgatgtcacgacataaggatccatg

SEQ ID NO: 108 - DNA, 200 bp, Amaranthus albus
ttctttatctctctatattcatctctctctctagcttattcacgacgccgatcacccttttccgaacccaggtaaaagtgaccaaacatggcacagatacttgcaccttacatgcaatgtcagctgaagttctcaaaaggttcaacaagttcaatgacatcaaatccttggacttcaatatttcttaaagaaaataaaaa

SEQ ID NO: 109 - DNA, 200 bp, Amaranthus albus
tttttattttctttaagaaatattgaagtccaaggatttgatgtcattgaacttgttgaaccttttgagaacttcagctgacattgcatgtaaggtgcaagtatctgtgccatgtttggtcacttttacctgggttcggaaaagggtgatcggcgtcgtgaataagctagagagagagatgaatatagagagataaagaa

SEQ ID NO: 110 - DNA, 200 bp, Amaranthus albus
caatatttcttaaagaaaataaaaagggatcaattaaatgctcgagtaagttcagagtatgtgcttctctccaatctgaaaatagcacaataaacagggtggagcagctactcaacttggatgtcactccatacactgacaagataattgcagagtacatttggattggaggatctggtattgatgtccgtagcaaatca

SEQ ID NO: 111 - DNA, 200 bp, Amaranthus albus
tgatttgctacggacatcaataccagatcctccaatccaaatgtactctgcaattatcttgtcagtgtatggagtgacatccaagttgagtagctgctccaccctgtttattgtgctattttcagattggagagaagcacatactctgaacttactcgagcatttaattgatccctttttattttctttaagaaatattg

SEQ ID NO: 112 - DNA, 200 bp, Amaranthus albus
tggtattgatgtccgtagcaaatcaaggactatctctaaacctgttgagcacccatctgagcttcccaagtggaattatgatggctcaagcacaggacaagcaccaggagaggacagtgaagtaatcttataccctcaagcaattttcaaggatccattccgtggtggtaataatatccttgtaatctgtgacacataca

SEQ ID NO: 113 - DNA, 200 bp, Amaranthus albus
tgtatgtgtcacagattacaaggatattattaccaccacggaatggatccttgaaaattgcttgagggtataagattacttcactgtcctctcctggtgcttgtcctgtgcttgagccatcataattccacttgggaagctcagatgggtgctcaacaggtttagagatagtccttgatttgctacggacatcaatacca

SEQ ID NO: 114 - DNA, 200 bp, Amaranthus albus
atccttgtaatctgtgacacatacacaccagcaggcgaacccatccccactaataaaagatacagggctgcacagatattcagcgacccaaaggttgtttctgagattccatggttcggaatagagcaggaatacactttgctccaacaaaatgttaaatggcctttgggatggcctgtgggagcctatcctggtcctca

SEQ ID NO: 115 - DNA, 200 bp, Amaranthus albus
tgaggaccaggataggctcccacaggccatcccaaaggccatttaacattttgttggagcaaagtgtattcctgctctattccgaaccatggaatctcagaaacaacctttgggtcgctgaatatctgtgcagccctgtatcttttattagtggggatgggttcgcctgctggtgtgtatgtgtcacagattacaaggat

SEQ ID NO: 116 - DNA, 200 bp, Amaranthus albus
ctgtgggagcctatcctggtcctcagggtccatactattgtggtgctggtgctgacaaatcttttggacgtgacatatctgatgctcattacaaagcttgcttgtatgctggtattaacattagtggcacaaatggggaagttatgcctggccagtgggaattccaagttggtccaagtgttggcattgaagctggagat

SEQ ID NO: 117 - DNA, 200 bp, Amaranthus albus
atctccagcttcaatgccaacacttggaccaacttggaattcccactggccaggcataacttccccatttgtgccactaatgttaataccagcatacaagcaagctttgtaatgagcatcagatatgtcacgtccaaaagatttgtcagcaccagcaccacaatagtatggaccctgaggaccaggataggctcccacag

SEQ ID NO: 118 - DNA, 200 bp, Amaranthus albus
aagtgttggcattgaagctggagatcatatctggtgtgctagatatattctggagagaattactgaacaagctggtgtggttctaactcttgatccaaagcctattgagggtgattggaatggtgcaggttgccatacaaattacagtacaaagaccatgagagaagatggtggttatgaagcaattaagaaggcaattt

SEQ ID NO: 119 - DNA, 200 bp, Amaranthus albus
aaattgccttcttaattgcttcataaccaccatcttctctcatggtctttgtactgtaatttgtatggcaacctgcaccattccaatcaccctcaataggctttggatcaagagttagaaccacaccagcttgttcagtaattctctccagaatatatctagcacaccagatatgatctccagcttcaatgccaacactt

SEQ ID NO: 120 - DNA, 200 bp, Amaranthus albus
tatgaagcaattaagaaggcaattttgaatctatcattacgtcacaaggaccatatcagtgcatatggagaaggaaatgaacgaagattgacagggaagcacgagaccgccagcatcgacacattctcttggggtgttgccaatcgtggttgctctatccgtgtgggtcgtgacacggaaaaggcaggcaaaggttatct

SEQ ID NO: 121 - DNA, 200 bp, Amaranthus albus
agataacctttgcctgccttttccgtgtcacgacccacacggatagagcaaccacgattggcaacaccccaagagaatgtgtcgatgctggcggtctcgtgcttccctgtcaatcttcgttcatttccttctccatatgcactgatatggtccttgtgacgtaatgatagattcaaaattgccttcttaattgcttcata

SEQ ID NO: 122 - DNA, 200 bp, Amaranthus albus
cggaaaaggcaggcaaaggttatctggaagataggcggcctgcttcaaacatggacccatacgtggtaacaggtttgctcgcagaaactacaatactttgggaaccaacacttgaggctgaggcactcgcagcccaaaaactcgctcttaatgtgtaattcaatcataaatcgtacgagaatatcgcatattcttgaggg

SEQ ID NO: 123 - DNA, 200 bp, Amaranthus albus
ccctcaagaatatgcgatattctcgtacgatttatgattgaattacacattaagagcgagtttttgggctgcgagtgcctcagcctcaagtgttggttcccaaagtattgtagtttctgcgagcaaacctgttaccacgtatgggtccatgtttgaagcaggccgcctatcttccagataacctttgcctgccttttccg

SEQ ID NO: 124 - DNA, 200 bp, Amaranthus albus
cgagaatatcgcatattcttgagggaggaactgtttcacgagccccgaatttgcttgtttttagtttttagtatcctgggactgggactgggtatgtatttcttgacctttgcttctggtcgtttgttttgggagttagaagagaagaatagtttgtgattgttacctatttatttttgctcttatgaagctcaagctca

SEQ ID NO: 125 - DNA, 200 bp, Amaranthus albus
tgagcttgagcttcataagagcaaaaataaataggtaacaatcacaaactattcttctcttctaactcccaaaacaaacgaccagaagcaaaggtcaagaaatacatacccagtcccagtcccaggatactaaaaactaaaaacaagcaaattcggggctcgtgaaacagttcctccctcaagaatatgcgatattctcg

SEQ ID NO: 126 - DNA, 200 bp, Amaranthus chlorostachys
ctctctagctcacccttttccgaacccaggtataagtgatcaaacatggcacaaatacttgcaccttacatgcaatgtcagatgaagttctcaaaaggctcaacaagttcaatgacatcaaatccttggacttcaatatttcttaaagaaaataaaaagggatcaattaaatgctctagtaagttcagagtatgtgcttc

SEQ ID NO: 127 - DNA, 200 bp, Amaranthus chlorostachys
gaagcacatactctgaacttactagagcatttaattgatccctttttattttctttaagaaatattgaagtccaaggatttgatgtcattgaacttgttgagccttttgagaacttcatctgacattgcatgtaaggtgcaagtatttgtgccatgtttgatcacttatacctgggttcggaaaagggtgagctagagag

SEQ ID NO: 128 - DNA, 200 bp, Amaranthus chlorostachys
ctagtaagttcagagtatgtgcttctctccaatctgaaaatagcacaataaacagggtggagcagctactcaacttggatgtcactccatacactgacaagataattgcagagtacatttggattggaggatctggtattgatgttcgtagcaaatcaaggacaatctctaaacctgttgagcacccatctgagcttccc

SEQ ID NO: 129 - DNA, 200 bp, Amaranthus chlorostachys
gggaagctcagatgggtgctcaacaggtttagagattgtccttgatttgctacgaacatcaataccagatcctccaatccaaatgtactctgcaattatcttgtcagtgtatggagtgacatccaagttgagtagctgctccaccctgtttattgtgctattttcagattggagagaagcacatactctgaacttactag

SEQ ID NO: 130 - DNA, 200 bp, Amaranthus chlorostachys
tacagggctgcacagatctttagcgacccaaaggttgtttctgagattccatggtttggaatagagcaggaatacacgttgctccaacaaaatgttaaatggcctttgggatggcctgttggagcctatcctggtcctcagggtccatactattgtggtgctggtgctgacaaatcttttggacgtgacatatctgatgc

SEQ ID NO: 131 - DNA, 200 bp, Amaranthus chlorostachys
gcatcagatatgtcacgtccaaaagatttgtcagcaccagcaccacaatagtatggaccctgaggaccaggataggctccaacaggccatcccaaaggccatttaacattttgttggagcaacgtgtattcctgctctattccaaaccatggaatctcagaaacaacctttgggtcgctaaagatctgtgcagccctgta

SEQ ID NO: 132 - DNA, 200 bp, Amaranthus chlorostachys
cttttggacgtgacatatctgatgctcattacaaagcttgcttgtatgctggcatcaacattagtggcacaaatggggaagttatgcctggccagtgggaattccaagttggcccaagtgttggtattgaagctggagatcatatctggtgtgcaagatatattcttgagagaattactgaacaagctggtgtggttctg

SEQ ID NO: 133 - DNA, 200 bp, Amaranthus chlorostachys
cagaaccacaccagcttgttcagtaattctctcaagaatatatcttgcacaccagatatgatctccagcttcaataccaacacttgggccaacttggaattcccactggccaggcataacttccccatttgtgccactaatgttgatgccagcatacaagcaagctttgtaatgagcatcagatatgtcacgtccaaaag

SEQ ID NO: 134 - DNA, 200 bp, Amaranthus chlorostachys
tactgaacaagctggtgtggttctgactcttgatccaaagcctattgagggtgattggaatggtgcaggttgccatacaaattacagtacaaagaccatgagagaagatggtggttatgaagcaattaagaaggcaattttgaatctatcattacgccacaaggaccatatcagtgcatatggagaaggaaatgaacgaa

SEQ ID NO: 135 - DNA, 200 bp, Amaranthus chlorostachys
ttcgttcatttccttctccatatgcactgatatggtccttgtggcgtaatgatagattcaaaattgccttcttaattgcttcataaccaccatcttctctcatggtctttgtactgtaatttgtatggcaacctgcaccattccaatcaccctcaataggctttggatcaagagtcagaaccacaccagcttgttcagta

SEQ ID NO: 136 - DNA, 200 bp, Amaranthus chlorostachys
gcatatggagaaggaaatgaacgaagattgacagggaagcacgagaccgccagcatcgacactttctcttggggtgttgccaatcgtggttgctctatccgtgtgggccgtgacacagaaaaagcaggcaaaggttatctggaagacaggcggcctgcctcaaacatggacccatacgtggtgacaggtttgctcgcaga

SEQ ID NO: 137 - DNA, 200 bp, Amaranthus chlorostachys
tctgcgagcaaacctgtcaccacgtatgggtccatgtttgaggcaggccgcctgtcttccagataacctttgcctgctttttctgtgtcacggcccacacggatagagcaaccacgattggcaacaccccaagagaaagtgtcgatgctggcggtctcgtgcttccctgtcaatcttcgttcatttccttctccatatgc

SEQ ID NO: 138 - DNA, 200 bp, Amaranthus chlorostachys
acgtggtgacaggtttgctcgcagaaactacaatactttgggaaccaacacttgaggctgaggcactagcagcccaaaaactcgctcttaatgtgtaattcaaccataatcgtgccagaatatcgcatattcatgaacgagggaaccctttcacgtgcccagaatttgcttatttttagtttttagtatcctgggtatgt

SEQ ID NO: 139 - DNA, 200 bp, Amaranthus chlorostachys
acatacccaggatactaaaaactaaaaataagcaaattctgggcacgtgaaagggttccctcgttcatgaatatgcgatattctggcacgattatggttgaattacacattaagagcgagtttttgggctgctagtgcctcagcctcaagtgttggttcccaaagtattgtagtttctgcgagcaaacctgtcaccacgt

SEQ ID NO: 140 - DNA, 200 bp, Amaranthus chlorostachys
ttagtttttagtatcctgggtatgtgagtgttttcattcatgacctttgcttctgatcattgtttgttttgggagttcaagagaagaataatttgtaactgttgccttcattatttttgctcttatgaagctcaagctcagtattagttatattccagattaaggaatgaacttcaaaatcctttgttactcatcttcaa

SEQ ID NO: 141 - DNA, 200 bp, Amaranthus chlorostachys
ttgaagatgagtaacaaaggattttgaagttcattccttaatctggaatataactaatactgagcttgagcttcataagagcaaaaataatgaaggcaacagttacaaattattcttctcttgaactcccaaaacaaacaatgatcagaagcaaaggtcatgaatgaaaacactcacatacccaggatactaaaaactaa

SEQ ID NO: 142 - DNA, 200 bp, Amaranthus graecizans
cattattccattctacccatacttgggacaatcatacctttataacacctttaaccatacacactctctcttctttatctctctaaattcttcactctctctctagttagttgacgccgccgaccaccttttccgaacccagtgaccaattatggcacagatacttgcacctaacatgcaatgtcagatgaagttctcca

SEQ ID NO: 143 - DNA, 200 bp, Amaranthus graecizans
tggagaacttcatctgacattgcatgttaggtgcaagtatctgtgccataattggtcactgggttcggaaaaggtggtcggcggcgtcaactaactagagagagagtgaagaatttagagagataaagaagagagagtgtgtatggttaaaggtgttataaaggtatgattgtcccaagtatgggtagaatggaataatg

SEQ ID NO: 144 - DNA, 200 bp, Amaranthus graecizans
atgcaatgtcagatgaagttctccaaagtctcgacaagttcaatgacattaagtccttggacttccatatttctgaaagaaaaccaaaagaaatcgattaaatgctctagtaagttcagagtatgtgcttctctcaagtctgaaaacagcactgtaaacagggtggagcagctactcaacttggatgtcactccatacac

SEQ ID NO: 145 - DNA, 200 bp, Amaranthus graecizans
gtgtatggagtgacatccaagttgagtagctgctccaccctgtttacagtgctgttttcagacttgagagaagcacatactctgaacttactagagcatttaatcgatttcttttggttttctttcagaaatatggaagtccaaggacttaatgtcattgaacttgtcgagactttggagaacttcatctgacattgcat

SEQ ID NO: 146 - DNA, 200 bp, Amaranthus graecizans
tcaacttggatgtcactccatacactgacaagattattgcggagtacatttggattggaggatctggtattgatgtccgtagcaaatcaaggactatctctaaacctgttgagcacccatctgagcttcccaagtggaattatgatggctcaagcacaggacaagcaccaggagaggatagtgaagtaatcttataccct

SEQ ID NO: 147 - DNA, 200 bp, Amaranthus graecizans
agggtataagattacttcactatcctctcctggtgcttgtcctgtgcttgagccatcataattccacttgggaagctcagatgggtgctcaacaggtttagagatagtccttgatttgctacggacatcaataccagatcctccaatccaaatgtactccgcaataatcttgtcagtgtatggagtgacatccaagttga

SEQ ID NO: 148 - DNA, 200 bp, Amaranthus graecizans
ggatagtgaagtaatcttataccctcaagcaattttcaaggatccattccgtggtggtaataatatccttgtaatctgtgacacatacaccccagcaggcgaacctattcccactaacaaaagatacagggctgcacagatattcagcgacccaaaggttgtttctgaggttccatggtttggaatagagcaggaataca

SEQ ID NO: 149 - DNA, 200 bp, Amaranthus graecizans
tgtattcctgctctattccaaaccatggaacctcagaaacaacctttgggtcgctgaatatctgtgcagccctgtatcttttgttagtgggaataggttcgcctgctggggtgtatgtgtcacagattacaaggatattattaccaccacggaatggatccttgaaaattgcttgagggtataagattacttcactatcc

SEQ ID NO: 150 - DNA, 200 bp, Amaranthus graecizans
tggtttggaatagagcaggaatacactttgctccaacaaaatgttaaatggcctttgggatggcctgtgggagcctatcctggtcctcagggtccatactattgtggtgctggtgctgacaaatcttttggacgtgacatatctgatgctcattacaaagcttgcttgtatgctggtattaacattagtggcacaaatgg

SEQ ID NO: 151 - DNA, 200 bp, Amaranthus graecizans
ccatttgtgccactaatgttaataccagcatacaagcaagctttgtaatgagcatcagatatgtcacgtccaaaagatttgtcagcaccagcaccacaatagtatggaccctgaggaccaggataggctcccacaggccatcccaaaggccatttaacattttgttggagcaaagtgtattcctgctctattccaaacca

SEQ ID NO: 152 - DNA, 200 bp, Amaranthus graecizans
gtattaacattagtggcacaaatggggaagttatgcctggccagtgggaattccaagttggtccaagtgttggcattgaagctggagatcatatctggtgtgctagatatattctggagagaattactgaacaagctggtgtggttctgactcttgatccaaagcctattgagggtgattggaatggtgcaggttgccat

SEQ ID NO: 153 - DNA, 200 bp, Amaranthus graecizans
atggcaacctgcaccattccaatcaccctcaataggctttggatcaagagtcagaaccacaccagcttgttcagtaattctctccagaatatatctagcacaccagatatgatctccagcttcaatgccaacacttggaccaacttggaattcccactggccaggcataacttccccatttgtgccactaatgttaatac

SEQ ID NO: 154 - DNA, 200 bp, Amaranthus graecizans
tgattggaatggtgcaggttgccatacaaattacagtacaaagaccatgagagaagatggtggttatgaagcaattaagaaggcaattttgaatctatcattacgtcacaaggaccatatcagtgcatatggagaaggaaatgaacgaagattgacagggaagcacgagaccgccagcatcgacacattctcttggggtg

SEQ ID NO: 155 - DNA, 200 bp, Amaranthus graecizans
caccccaagagaatgtgtcgatgctggcggtctcgtgcttccctgtcaatcttcgttcatttccttctccatatgcactgatatggtccttgtgacgtaatgatagattcaaaattgccttcttaattgcttcataaccaccatcttctctcatggtctttgtactgtaatttgtatggcaacctgcaccattccaatca

SEQ ID NO: 156 - DNA, 200 bp, Amaranthus graecizans
agcatcgacacattctcttggggtgttgccaatcgtggttgctctatccgtgtgggtcgtgacacggaaaaggcaggcaaaggttatctagaagataggcggcctgcctcaaacatggacccatacgtggtaacaggtttgctcgcagaaactacaatactttgggaacccacacttgaggccgagtcacttgcagctca

SEQ ID NO: 157 - DNA, 200 bp, Amaranthus graecizans
tgagctgcaagtgactcggcctcaagtgtgggttcccaaagtattgtagtttctgcgagcaaacctgttaccacgtatgggtccatgtttgaggcaggccgcctatcttctagataacctttgcctgccttttccgtgtcacgacccacacggatagagcaaccacgattggcaacaccccaagagaatgtgtcgatgct

SEQ ID NO: 158 - DNA, 200 bp, Amaranthus graecizans
ttgaggccgagtcacttgcagctcaaaaactcgctcttaatgtgtaattccaaccataaaacgaagcagaatatctcatattcttgagggagggaactgtttcacgagccccgaatttgcttgtttttagtttttagtatcctgggactgggactgggtatgtatttcttgacctttgcttctggtcgtttgttttggga

SEQ ID NO: 159 - DNA, 200 bp, Amaranthus graecizans
tcccaaaacaaacgaccagaagcaaaggtcaagaaatacatacccagtcccagtcccaggatactaaaaactaaaaacaagcaaattcggggctcgtgaaacagttccctccctcaagaatatgagatattctgcttcgttttatggttggaattacacattaagagcgagtttttgagctgcaagtgactcggcctcaa

SEQ ID NO: 160 - DNA, 200 bp, Amaranthus hybridus
cccgtcgttcccgtccggttccgatctgtaaacaatcaaaaccgacgcttctgatagccaagatcaatgcactgcaatcggctagaacggttcctcgacgtagtcgtctccttctaatagatgacagccaagaaaacgccacaaaatcgtgttcaaatgaaaagatatacggcttagattcaatgctcaaatgtacaagt

SEQ ID NO: 161 - DNA, 200 bp, Amaranthus hybridus
acttgtacatttgagcattgaatctaagccgtatatcttttcatttgaacacgattttgtggcgttttcttggctgtcatctattagaaggagacgactacgtcgaggaaccgttctagccgattgcagtgcattgatcttggctatcagaagcgtcggttttgattgtttacagatcggaaccggacgggaacgacggg

SEQ ID NO: 162 - DNA, 200 bp, Amaranthus hybridus
agattcaatgctcaaatgtacaagtccaggctacactccatccttctttctcactcctttatctctctctctctagctcacccttttccgaacccaggtaaaagtgatcaaacatggcacaaatacttgcaccttacatgcaatgtcagatgaagttctcaaaaggctcaacaagttcaatgacatcaaatccttggact

SEQ ID NO: 163 - DNA, 200 bp, Amaranthus hybridus
agtccaaggatttgatgtcattgaacttgttgagccttttgagaacttcatctgacattgcatgtaaggtgcaagtatttgtgccatgtttgatcacttttacctgggttcggaaaagggtgagctagagagagagagataaaggagtgagaaagaaggatggagtgtagcctggacttgtacatttgagcattgaatct

SEQ ID NO: 164 - DNA, 200 bp, Amaranthus hybridus
ttcaatgacatcaaatccttggacttcaatatttcttaaagaaaataaaaagggatcaattaaatgctctagtaagtttagagtatgtgcttctctccaatctgaaaatagcacaataaacagggtggagcagctactcaacttggatgtcactccatacactgacaagataattgcagagtacatttggattggaggat

SEQ ID NO: 165 - DNA, 200 bp, Amaranthus hybridus
atcctccaatccaaatgtactctgcaattatcttgtcagtgtatggagtgacatccaagttgagtagctgctccaccctgtttattgtgctattttcagattggagagaagcacatactctaaacttactagagcatttaattgatccctttttattttctttaagaaatattgaagtccaaggatttgatgtcattgaa

SEQ ID NO: 166 - DNA, 200 bp, Amaranthus hybridus
gcagagtacatttggattggaggatctggtattgatgttcgtagcaaatcaaggacaatctctaaacctgttgagcacccatctgagcttcccaagtggaattatgatggctcaagcactggacaagcgccaggagaggacagtgaagtaatcttataccctcaagcaattttcaaggatccgttccgtggtggtaataa

SEQ ID NO: 167 - DNA, 200 bp, Amaranthus hybridus
ttattaccaccacggaacggatccttgaaaattgcttgagggtataagattacttcactgtcctctcctggcgcttgtccagtgcttgagccatcataattccacttgggaagctcagatgggtgctcaacaggtttagagattgtccttgatttgctacgaacatcaataccagatcctccaatccaaatgtactctgc

SEQ ID NO: 168 - DNA, 200 bp, Amaranthus hybridus
aggatccgttccgtggtggtaataatatccttgtaatctgtgacacatacacaccagcaggcgaacccatccccactaataaaagatacagggctgcacagatctttagcgacccaaaggttgtttctgagattccatggtttggaatagagcaggaatacacgttgctccaacaaaacgttaaatggcctttgggatgg

SEQ ID NO: 169 - DNA, 200 bp, Amaranthus hybridus
ccatcccaaaggccatttaacgttttgttggagcaacgtgtattcctgctctattccaaaccatggaatctcagaaacaacctttgggtcgctaaagatctgtgcagccctgtatcttttattagtggggatgggttcgcctgctggtgtgtatgtgtcacagattacaaggatattattaccaccacggaacggatcct

SEQ ID NO: 170 - DNA, 200 bp, Amaranthus hybridus
aaacgttaaatggcctttgggatggcctgttggagcctatcctggtcctcagggtccatactattgtggtgctggtgctgacaaatcttttggacgtgacatatctgatgctcattacaaagcttgcttgtatgctggcatcaacattagtggcacaaatggggaagttatgcctggccagtgggaattccaagttggcc

SEQ ID NO: 171 - DNA, 200 bp, Amaranthus hybridus
ggccaacttggaattcccactggccaggcataacttccccatttgtgccactaatgttgatgccagcatacaagcaagctttgtaatgagcatcagatatgtcacgtccaaaagatttgtcagcaccagcaccacaatagtatggaccctgaggaccaggataggctccaacaggccatcccaaaggccatttaacgttt

SEQ ID NO: 172 - DNA, 200 bp, Amaranthus hybridus
ggccagtgggaattccaagttggcccaagtgttggtattgaagctggagatcatatctggtgtgcaagatatattcttgagagaatcactgaacaagctggtgtggttctgactttggatccaaagcctattgagggtgattggaacggtgcaggttgccataccaattacagtacaaagaccatgagagaagatggtgg

SEQ ID NO: 173 - DNA, 200 bp, Amaranthus hybridus
ccaccatcttctctcatggtctttgtactgtaattggtatggcaacctgcaccgttccaatcaccctcaataggctttggatccaaagtcagaaccacaccagcttgttcagtgattctctcaagaatatatcttgcacaccagatatgatctccagcttcaataccaacacttgggccaacttggaattcccactggcc

SEQ ID NO: 174 - DNA, 200 bp, Amaranthus hybridus
caaagaccatgagagaagatggtggttatgaagcaattaagaaggcaattttgaatctatcattacgccacaaggaccatatcagtgcatatggagaaggaaatgaacgaagattgacagggaagcacgagaccgccagcatcgacacattctcttggggtgttgccaatcgtggttgctctatccgtgtgggccgtgac

SEQ ID NO: 175 - DNA, 200 bp, Amaranthus hybridus
gtcacggcccacacggatagagcaaccacgattggcaacaccccaagagaatgtgtcgatgctggcggtctcgtgcttccctgtcaatcttcgttcatttccttctccatatgcactgatatggtccttgtggcgtaatgatagattcaaaattgccttcttaattgcttcataaccaccatcttctctcatggtctttg

SEQ ID NO: 176 - DNA, 200 bp, Amaranthus hybridus
ttgctctatccgtgtgggccgtgacacagaaaaagcaggcaaaggttatctggaagacaggcggcctgcctcaaacatggacccatacgtggtgacaggtttgctcgcagaaactacaatactttgggaaccaacacttgaggctgaggcactagcagcccaaaaactcgctcttaatgtgtaattcaatcataatcgtg

SEQ ID NO: 177 - DNA, 200 bp, Amaranthus hybridus
cacgattatgattgaattacacattaagagcgagtttttgggctgctagtgcctcagcctcaagtgttggttcccaaagtattgtagtttctgcgagcaaacctgtcaccacgtatgggtccatgtttgaggcaggccgcctgtcttccagataacctttgcctgctttttctgtgtcacggcccacacggatagagcaa

SEQ ID NO: 178 - DNA, 200 bp, Amaranthus hybridus
aatgtgtaattcaatcataatcgtgccagaatatcgcatattcatgaacgagggaactctttcacgtgcccagaatttgcttatttttagtttttagtatcctgggtatgtgagtgttttcattcatgacctttgcttctgatcattgtttgttttgggagttcaagagaagaataatttgtaactgttgccttcattat

SEQ ID NO: 179 - DNA, 200 bp, Amaranthus hybridus
ataatgaaggcaacagttacaaattattcttctcttgaactcccaaaacaaacaatgatcagaagcaaaggtcatgaatgaaaacactcacatacccaggatactaaaaactaaaaataagcaaattctgggcacgtgaaagagttccctcgttcatgaatatgcgatattctggcacgattatgattgaattacacatt

SEQ ID NO: 180 - DNA, 200 bp, Amaranthus lividus
cccatttcattctgcttactctccatccttctttctcactcctttatctctctctctctagctcacccttttccgaacccaggtaaaagtgatcaaacatggcacaaatacttgcaccttacatgcaatgtcagatgaagttctcaaaaggctcaacaagttcaatgacatcaaatccttggacttcaatatttcttaaa

SEQ ID NO: 181 - DNA, 200 bp, Amaranthus lividus
tttaagaaatattgaagtccaaggatttgatgtcattgaacttgttgagccttttgagaacttcatctgacattgcatgtaaggtgcaagtatttgtgccatgtttgatcacttttacctgggttcggaaaagggtgagctagagagagagagataaaggagtgagaaagaaggatggagagtaagcagaatgaaatggg

SEQ ID NO: 182 - DNA, 200 bp, Amaranthus lividus
tccttggacttcaatatttcttaaagaaaataaaaagggatcaattaaatgctctagtaagttcagagtatgtgcttctctccaatctgaaaatagcacaataaacagggtggagcagctactcaacttggatgtcactccatacactgacaagataattgcagagtacatttggattggaggatctggtattgatgttc

SEQ ID NO: 183 - DNA, 200 bp, Amaranthus lividus
gaacatcaataccagatcctccaatccaaatgtactctgcaattatcttgtcagtgtatggagtgacatccaagttgagtagctgctccaccctgtttattgtgctattttcagattggagagaagcacatactctgaacttactagagcatttaattgatccctttttattttctttaagaaatattgaagtccaagga

SEQ ID NO: 184 - DNA, 200 bp, Amaranthus lividus
attggaggatctggtattgatgttcgtagcaaatcaaggacaatctctaaacctgttgagcacccatctgagcttcccaagtggaattatgatggctcaagcactggacaagcgccaggagaggacagtgaagtaatcttataccctcaagcaattttcaaggatccgttccgtggtggtaataatatccttgtaatctg

SEQ ID NO: 185 - DNA, 200 bp, Amaranthus lividus
cagattacaaggatattattaccaccacggaacggatccttgaaaattgcttgagggtataagattacttcactgtcctctcctggcgcttgtccagtgcttgagccatcataattccacttgggaagctcagatgggtgctcaacaggtttagagattgtccttgatttgctacgaacatcaataccagatcctccaat

SEQ ID NO: 186 - DNA, 200 bp, Amaranthus lividus
gtggtaataatatccttgtaatctgtgacacatacacaccagcaggcgaacccatccccactaataaaagatacagggctgcacagatctttagcgacccaaaggttgtttctgagattccatggtttggaatagagcaggaatacacgttgctccaacaaaatgttaaatggcctttgggatggcctgttggagcctat

SEQ ID NO: 187 - DNA, 200 bp, Amaranthus lividus
ataggctccaacaggccatcccaaaggccatttaacattttgttggagcaacgtgtattcctgctctattccaaaccatggaatctcagaaacaacctttgggtcgctaaagatctgtgcagccctgtatcttttattagtggggatgggttcgcctgctggtgtgtatgtgtcacagattacaaggatattattaccac

SEQ ID NO: 188 - DNA, 200 bp, Amaranthus lividus
tttgggatggcctgttggagcctatcctggtcctcagggtccatactattgtggtgctggtgctgacaaatcttttggacgtgacatatctgatgctcattacaaagcttgcttgtatgctggcatcaacattagtggcacaaatggggaagttatgcctggccagtgggaattccaagttggcccaagtgttggtattg

SEQ ID NO: 189 - DNA, 200 bp, Amaranthus lividus
caataccaacacttgggccaacttggaattcccactggccaggcataacttccccatttgtgccactaatgttgatgccagcatacaagcaagctttgtaatgagcatcagatatgtcacgtccaaaagatttgtcagcaccagcaccacaatagtatggaccctgaggaccaggataggctccaacaggccatcccaaa

SEQ ID NO: 190 - DNA, 200 bp, Amaranthus lividus
caagttggcccaagtgttggtattgaagctggagatcatatctggtgtgcaagatatattcttgagagaattactgaacaagctggtgtggttctgactcttgatccaaagcctattgagggtgattggaacggtgcaggttgccataccaattacagtacaaagaccatgagagaagatggtggttatgaagcaattaa

SEQ ID NO: 191 - DNA, 200 bp, Amaranthus lividus
ttaattgcttcataaccaccatcttctctcatggtctttgtactgtaattggtatggcaacctgcaccgttccaatcaccctcaataggctttggatcaagagtcagaaccacaccagcttgttcagtaattctctcaagaatatatcttgcacaccagatatgatctccagcttcaataccaacacttgggccaacttg

SEQ ID NO: 192 - DNA, 200 bp, Amaranthus lividus
aagatggtggttatgaagcaattaagaaggcaattttgaatctatcattacgccacaaggaccatatcagtgcatatggagaaggaaatgaacgaagattgacagggaagcacgagaccgccagcatcgacactttctcttggggtgttgccaatcgtggttgctctatccgtgtgggccgtgacacagaaaaagcaggc

SEQ ID NO: 193 - DNA, 200 bp, Amaranthus lividus
gcctgctttttctgtgtcacggcccacacggatagagcaaccacgattggcaacaccccaagagaaagtgtcgatgctggcggtctcgtgcttccctgtcaatcttcgttcatttccttctccatatgcactgatatggtccttgtggcgtaatgatagattcaaaattgccttcttaattgcttcataaccaccatctt

SEQ ID NO: 194 - DNA, 200 bp, Amaranthus lividus
gggccgtgacacagaaaaagcaggcaaaggttatctggaagacaggcggcctgcctcaaacatggacccatacgtggtgacaggtttgctcgcagaaactacaatactttgggaaccaacacttgaggctgaggcactagcagcccaaaaactcgctcttaatgtgtaattcaaccataatcgtgccagaatatcgcata

SEQ ID NO: 195 - DNA, 200 bp, Amaranthus lividus
tatgcgatattctggcacgattatggttgaattacacattaagagcgagtttttgggctgctagtgcctcagcctcaagtgttggttcccaaagtattgtagtttctgcgagcaaacctgtcaccacgtatgggtccatgtttgaggcaggccgcctgtcttccagataacctttgcctgctttttctgtgtcacggccc

SEQ ID NO: 196 - DNA, 200 bp, Amaranthus lividus
cataatcgtgccagaatatcgcatattcatgaacgagggaactctttcacgtgcccagaatttgcttattttagttttagtatcctgggtatgtgagtgttttcattcatgacctttgcttctgatcattgtttgttttgggagttcaagagaagaataatttgtaactgttgccttcattatttttgctactccgccaa

SEQ ID NO: 197 - DNA, 200 bp, Amaranthus lividus
ttggcggagtagcaaaaataatgaaggcaacagttacaaattattcttctcttgaactcccaaaacaaacaatgatcagaagcaaaggtcatgaatgaaaacactcacatacccaggatactaaaactaaaataagcaaattctgggcacgtgaaagagttccctcgttcatgaatatgcgatattctggcacgattatg

SEQ ID NO: 198 - DNA, 200 bp, Amaranthus palmeri
agctgtattaagatgctatattagggtttttgctacacttgaacatgggtaaatggtacccaattggttgaaacttgaaactaggatatttcaattgtgatttttccctttgtttgactttccccggatgctttgtgggttgatattggcgtggtaatggggaagatcaattgttttaggatcaggttttaggtattcat

SEQ ID NO: 199 - DNA, 200 bp, Amaranthus palmeri
atgaatacctaaaacctgatcctaaaacaattgatcttccccattaccacgccaatatcaacccacaaagcatccggggaaagtcaaacaaagggaaaaatcacaattgaaatatcctagtttcaagtttcaaccaattgggtaccatttacccatgttcaagtgtagcaaaaaccctaatatagcatcttaatacagct

SEQ ID NO: 200 - DNA, 200 bp, Amaranthus palmeri
ttaggatcaggttttaggtattcattacctctaaactccctttatggtatgatttgtcgccttccttccctttccagaccctgatcatagtttccttatgagtgggatacactagtcaagatgatcatgatgatgatgataattttagctattccttgtgctagagtcattgatcagtgttacaaatttcccaaacaaat

SEQ ID NO: 201 - DNA, 200 bp, Amaranthus palmeri
atttgtttgggaaatttgtaacactgatcaatgactctagcacaaggaatagctaaaattatcatcatcatcatgatcatcttgactagtgtatcccactcataaggaaactatgatcagggtctggaaagggaaggaaggcgacaaatcataccataaagggagtttagaggtaatgaatacctaaaacctgatcctaa

SEQ ID NO: 202 - DNA, 200 bp, Amaranthus palmeri
agtgttacaaatttcccaaacaaatttgatgagatggaagataattattaaagctacattttgtcggaatactattgaaattaatcacttgttagaatatgtaagtaggttattacattattagtcacttgttaatgtcattttaatatggagggagtatggttttgtggttttcctagctaacaatctatacctgcggt

SEQ ID NO: 203 - DNA, 200 bp, Amaranthus palmeri
accgcaggtatagattgttagctaggaaaaccacaaaaccatactccctccatattaaaatgacattaacaagtgactaataatgtaataacctacttacatattctaacaagtgattaatttcaatagtattccgacaaaatgtagctttaataattatcttccatctcatcaaatttgtttgggaaatttgtaacact

SEQ ID NO: 204 - DNA, 200 bp, Amaranthus palmeri
ctagctaacaatctatacctgcggtcctgctggctatttctttccaggctcatgttagtatagtgtataagtggccccaacttatcagaaagatggattttggcattaactatgtgactatgtccaagtatattgaacacttttatttctagtttcatttatctcctgtacttatttgagacctgctcttgtgcttcata

SEQ ID NO: 205 - DNA, 200 bp, Amaranthus palmeri
tatgaagcacaagagcaggtctcaaataagtacaggagataaatgaaactagaaataaaagtgttcaatatacttggacatagtcacatagttaatgccaaaatccatctttctgataagttggggccacttatacactatactaacatgagcctggaaagaaatagccagcaggaccgcaggtatagattgttagctag

SEQ ID NO: 206 - DNA, 200 bp, Amaranthus palmeri
ttgagacctgctcttgtgcttcatataaaaaattacacaaaggttacaaaacactgttggactaaaacataaggaactcgcctttacaacaattgaaattttctcatctcattcatatagtgagctactatttgtgcgcgagcgattaccgaatagtgattacatcatctcttttgcctatgtgtttgtattacttgcat

SEQ ID NO: 207 - DNA, 200 bp, Amaranthus palmeri
atgcaagtaatacaaacacataggcaaaagagatgatgtaatcactattcggtaatcgctcgcgcacaaatagtagctcactatatgaatgagatgagaaaatttcaattgttgtaaaggcgagttccttatgttttagtccaacagtgttttgtaacctttgtgtaattttttatatgaagcacaagagcaggtctcaa

SEQ ID NO: 208 - DNA, 200 bp, Amaranthus palmeri
gcctatgtgtttgtattacttgcatttgcatactcatgtcatgtacatgtggattttcatgctcaaacttgaatactttatgaagacatatctgaaacacatgtgcatttgtattaccacatttttttatccaaaatgatattccaaatgtattgtatgtcggggtgcccagcatttaatccaaaagtttcataaacctt

SEQ ID NO: 209 - DNA, 200 bp, Amaranthus palmeri
aaggtttatgaaacttttggattaaatgctgggcaccccgacatacaatacatttggaatatcattttggataaaaaaatgtggtaatacaaatgcacatgtgtttcagatatgtcttcataaagtattcaagtttgagcatgaaaatccacatgtacatgacatgagtatgcaaatgcaagtaatacaaacacataggc

SEQ ID NO: 210 - DNA, 200 bp, Amaranthus palmeri
ttaatccaaaagtttcataaaccttgagtgaccgagatgcaaatctgtggcaatctgatctaaaggtttcataaatcctagaattcaaagcagacatatctgaaacacataaattaacgtgttatgcccatgtactcgaaaatgtttcctggaaactgagattggttttttaacataagttgactcttgaccattgtgtg

SEQ ID NO: 211 - DNA, 200 bp, Amaranthus palmeri
cacacaatggtcaagagtcaacttatgttaaaaaaccaatctcagtttccaggaaacattttcgagtacatgggcataacacgttaatttatgtgtttcagatatgtctgctttgaattctaggatttatgaaacctttagatcagattgccacagatttgcatctcggtcactcaaggtttatgaaacttttggattaa

SEQ ID NO: 212 - DNA, 200 bp, Amaranthus palmeri
taagttgactcttgaccattgtgtgtttggttagcaatctacctgagtaactcacatatgtaataccctaacatattttatttgtgttgtaggtaaaagtgaccaaacatggcacaaatacttgcaccttacatgcaatgtcagatgaagttttcaaaaggctccacaagttcaatgacatcaaatccttggacttcaat

SEQ ID NO: 213 - DNA, 200 bp, Amaranthus palmeri
attgaagtccaaggatttgatgtcattgaacttgtggagccttttgaaaacttcatctgacattgcatgtaaggtgcaagtatttgtgccatgtttggtcacttttacctacaacacaaataaaatatgttagggtattacatatgtgagttactcaggtagattgctaaccaaacacacaatggtcaagagtcaactta

SEQ ID NO: 214 - DNA, 200 bp, Amaranthus palmeri
tgacatcaaatccttggacttcaatatttcttaaagaaaataaaaagggatcaattaaatgctctagtaagttcagagtatgtgcttctctccaatctgataatagcacagtaaacagggtggagcagctactcaacttggatgtcactccatacactgacaagataattgcagagtacatttggtatatgttttttctt

SEQ ID NO: 215 - DNA, 200 bp, Amaranthus palmeri
aagaaaaaacatataccaaatgtactctgcaattatcttgtcagtgtatggagtgacatccaagttgagtagctgctccaccctgtttactgtgctattatcagattggagagaagcacatactctgaacttactagagcatttaattgatccctttttattttctttaagaaatattgaagtccaaggatttgatgtca

SEQ ID NO: 216 - DNA, 200 bp, Amaranthus palmeri
gtacatttggtatatgttttttctttgctatatgatcaaaaatgtcgctgactctaggccagacgtaacattaattttttttagctaatgtttgtgctacttttggttttttctcatctgtagataagacattcttggtggtttctactttcaatctgattatagaactaattgatctacgattgttctttggaacagga

SEQ ID NO: 217 - DNA, 200 bp, Amaranthus palmeri
tcctgttccaaagaacaatcgtagatcaattagttctataatcagattgaaagtagaaaccaccaagaatgtcttatctacagatgagaaaaaaccaaaagtagcacaaacattagctaaaaaaaattaatgttacgtctggcctagagtcagcgacatttttgatcatatagcaaagaaaaaacatataccaaatgtac

SEQ ID NO: 218 - DNA, 200 bp, Amaranthus palmeri
tctacgattgttctttggaacaggattggaggatctggtattgatgtccgtagcaaatcaagggtacaataacactgatgctgtcgatttattgttaaaccagcatttagatgttaagtttactccattttttccctgaccgatgtttcttaatataccagacaatctctaaacctgttgagcacccatctgagcttccc

SEQ ID NO: 219 - DNA, 200 bp, Amaranthus palmeri
gggaagctcagatgggtgctcaacaggtttagagattgtctggtatattaagaaacatcggtcagggaaaaaatggagtaaacttaacatctaaatgctggtttaacaataaatcgacagcatcagtgttattgtacccttgatttgctacggacatcaataccagatcctccaatcctgttccaaagaacaatcgtaga

SEQ ID NO: 220 - DNA, 200 bp, Amaranthus palmeri
tgttgagcacccatctgagcttcccaagtggaattatgatggctcaagcactggacaagcgccaggagaggacagtgaagtaatcttatagtaagatcttggggcagctataaacctttattactttgctcaattattgttgtccttgtttttgcttgactatcttttgaggcttgagagttcttgtcactgaactaact

SEQ ID NO: 221 - DNA, 200 bp, Amaranthus palmeri
agttagttcagtgacaagaactctcaagcctcaaaagatagtcaagcaaaaacaaggacaacaataattgagcaaagtaataaaggtttatagctgccccaagatcttactataagattacttcactgtcctctcctggcgcttgtccagtgcttgagccatcataattccacttgggaagctcagatgggtgctcaaca

SEQ ID NO: 222 - DNA, 200 bp, Amaranthus palmeri
gagagttcttgtcactgaactaactcaaaaagcttaagctttcatttggttcgattccttgacatggtatcggaaggttagcttacgggtttgaatctcatttaccctccggtaattattattactaagtatttgtgtcgtgtccacacttctagttagggctttcgtgtgagggggcgtggtaggacctcaaccatcaa

SEQ ID NO: 223 - DNA, 200 bp, Amaranthus palmeri
ttgatggttgaggtcctaccacgccccctcacacgaaagccctaactagaagtgtggacacgacacaaatacttagtaataataattaccggagggtaaatgagattcaaacccgtaagctaaccttccgataccatgtcaaggaatcgaaccaaatgaaagcttaagctttttgagttagttcagtgacaagaactctc

SEQ ID NO: 224 - DNA, 200 bp, Amaranthus palmeri
ggcgtggtaggacctcaaccatcaacttaagatttgtttgagttgattcctagacaattcttgtcactcattaattcataatcatgtcattcatatgcagccctcaagcaattttcaaggatccattccgtggtggtaataatatccttgtgagtcatattctatctgactgttatgaaactcaatatttattccaaaat

SEQ ID NO: 225 - DNA, 200 bp, Amaranthus palmeri
attttggaataaatattgagtttcataacagtcagatagaatatgactcacaaggatattattaccaccacggaatggatccttgaaaattgcttgagggctgcatatgaatgacatgattatgaattaatgagtgacaagaattgtctaggaatcaactcaaacaaatcttaagttgatggttgaggtcctaccacgcc

SEQ ID NO: 226 - DNA, 200 bp, Amaranthus palmeri
tgaaactcaatatttattccaaaattatgatgttacctcaattgttgagattagaattttaattatgcattgccatgtaaatttaggtaatctgtgacacatacacaccagcaggcgaacccatccccactaataaaagatacagggctgcacagatctttagcgacccaaaggttgtttctgagattccatggtaagaa

SEQ ID NO: 227 - DNA, 200 bp, Amaranthus palmeri
ttcttaccatggaatctcagaaacaacctttgggtcgctaaagatctgtgcagccctgtatcttttattagtggggatgggttcgcctgctggtgtgtatgtgtcacagattacctaaatttacatggcaatgcataattaaaattctaatctcaacaattgaggtaacatcataattttggaataaatattgagtttca

SEQ ID NO: 228 - DNA, 200 bp, Amaranthus palmeri
tgtttctgagattccatggtaagaaattcccatcattgacaatattttgttcctaatcatatttcctaatttaacactctcccttgcaagggtgaactttatagaaagttgacccactatctgagaaatgacaaattaaaaactgatttctctagttttctaataaaagacaatgcataaattatgtgatggataccact

SEQ ID NO: 229 - DNA, 200 bp, Amaranthus palmeri
agtggtatccatcacataatttatgcattgtcttttattagaaaactagagaaatcagtttttaatttgtcatttctcagatagtgggtcaactttctataaagttcacccttgcaagggagagtgttaaattaggaaatatgattaggaacaaaatattgtcaatgatgggaatttcttaccatggaatctcagaaaca

SEQ ID NO: 230 - DNA, 200 bp, Amaranthus palmeri
cataaattatgtgatggataccactaagggaataacctcaccaaagttcacttaaatttgaaggttaaattgtgggatgtacaatctaaactctcaatgtttcttttggattctagggaatgcttatccaagcttaaaactgatctttttgaattttgagtaagattgaactccgaattcattcaaaattttcaagagct

SEQ ID NO: 231 - DNA, 200 bp, Amaranthus palmeri
agctcttgaaaattttgaatgaattcggagttcaatcttactcaaaattcaaaaagatcagttttaagcttggataagcattccctagaatccaaaagaaacattgagagtttagattgtacatcccacaatttaaccttcaaatttaagtgaactttggtgaggttattcccttagtggtatccatcacataatttatg

SEQ ID NO: 232 - DNA, 200 bp, Amaranthus palmeri
aattcattcaaaattttcaagagctcgtcaatattacaactcaagctttgacaaaatcaaaacaatcattcgtgtaaacacaatgaatttgtttaaggtgttcaactttgtattctctaaataatgcatacaacctagggccccaggctacttcaacgagaacatacctctagtccgactcttactaggaatttcctaaa

SEQ ID NO: 233 - DNA, 200 bp, Amaranthus palmeri
tttaggaaattcctagtaagagtcggactagaggtatgttctcgttgaagtagcctggggccctaggttgtatgcattatttagagaatacaaagttgaacaccttaaacaaattcattgtgtttacacgaatgattgttttgattttgtcaaagcttgagttgtaatattgacgagctcttgaaaattttgaatgaatt

SEQ ID NO: 234 - DNA, 200 bp, Amaranthus palmeri
cgactcttactaggaatttcctaaataatgctaaatcaaatatcttctggattgatttagctgcaagtatcaaacaatatattactattactcgaattaaaaagtaatcctacccttatccggagtgtaaaaatatccggctatcctgtaagaaaaccataacctaaacctacgtctactaggatatggtcaaactatga

SEQ ID NO: 235 - DNA, 200 bp, Amaranthus palmeri
tcatagtttgaccatatcctagtagacgtaggtttaggttatggttttcttacaggatagccggatatttttacactccggataagggtaggattactttttaattcgagtaatagtaatatattgtttgatacttgcagctaaatcaatccagaagatatttgatttagcattatttaggaaattcctagtaagagtcg

SEQ ID NO: 236 - DNA, 200 bp, Amaranthus palmeri
ctactaggatatggtcaaactatgaagaagcttccaaggatatttgacatggatagaactttgacttttaactcatacaagccaacatcactttgcaaacaagtgaataaatgatccaagctgggactacggagaggacaaaatgcgcacttgttcacattagaaaaattactaacaggaagtattcatttgaacaagct

SEQ ID NO: 237 - DNA, 200 bp, Amaranthus palmeri
agcttgttcaaatgaatacttcctgttagtaatttttctaatgtgaacaagtgcgcattttgtcctctccgtagtcccagcttggatcatttattcacttgtttgcaaagtgatgttggcttgtatgagttaaaagtcaaagttctatccatgtcaaatatccttggaagcttcttcatagtttgaccatatcctagtag

SEQ ID NO: 238 - DNA, 200 bp, Amaranthus palmeri
caggaagtattcatttgaacaagctaggacttcaagtaatgcctttgatcttgtgtcaatggttagcagtcgtaatacagtatgtcacacacttgtaattaacataacaaatctgttgttttaaatatgacggtttgaatacccatgttctacgggaggcatttcactataaaggtcaaccgtttttgcccagtttggag

SEQ ID NO: 239 - DNA, 200 bp, Amaranthus palmeri
ctccaaactgggcaaaaacggttgacctttatagtgaaatgcctcccgtagaacatgggtattcaaaccgtcatatttaaaacaacagatttgttatgttaattacaagtgtgtgacatactgtattacgactgctaaccattgacacaagatcaaaggcattacttgaagtcctagcttgttcaaatgaatacttcctg

SEQ ID NO: 240 - DNA, 200 bp, Amaranthus palmeri
tcaaccgtttttgcccagtttggagcttgacaattgcaaaagtaattcaggggtctgcttttctagaattctagatcataaaagcctctttgatctgtgttttctcttttttttttccctctctactcttcgatttattctgttaattttacttctacaggtttggaatagagcaggaatacacgttgctccaacaaaat

SEQ ID NO: 241 - DNA, 200 bp, Amaranthus palmeri
attttgttggagcaacgtgtattcctgctctattccaaacctgtagaagtaaaattaacagaataaatcgaagagtagagagggaaaaaaaaaagagaaaacacagatcaaagaggcttttatgatctagaattctagaaaagcagacccctgaattacttttgcaattgtcaagctccaaactgggcaaaaacggttga

SEQ ID NO: 242 - DNA, 200 bp, Amaranthus palmeri
ggaatacacgttgctccaacaaaatgttaaatggcctttgggatggcctgtgggagcctatcctggtcctcaggtgtgttaattccccatattatcaacagtttctttgaagataatgctttgtttctgttatataatatgatttttttgatatgtctagggtccatactattgtggtgctggtgctgacaagtcttttg

SEQ ID NO: 243 - DNA, 200 bp, Amaranthus palmeri
caaaagacttgtcagcaccagcaccacaatagtatggaccctagacatatcaaaaaaatcatattatataacagaaacaaagcattatcttcaaagaaactgttgataatatggggaattaacacacctgaggaccaggataggctcccacaggccatcccaaaggccatttaacattttgttggagcaacgtgtattcc

SEQ ID NO: 244 - DNA, 200 bp, Amaranthus palmeri
ggtgctggtgctgacaagtcttttggacgtgacatatctgatgctcattacaaagcttgcttgtatgctggcatcaacattagtggcacaaatggggaagttatgcctggccaggtttcgtcttgcatcactctcatgtgttattgttaattaatatgtctttgaagttggttacgaatagctacctccacttgcccctg

SEQ ID NO: 245 - DNA, 200 bp, Amaranthus palmeri
caggggcaagtggaggtagctattcgtaaccaacttcaaagacatattaattaacaataacacatgagagtgatgcaagacgaaacctggccaggcataacttccccatttgtgccactaatgttgatgccagcatacaagcaagctttgtaatgagcatcagatatgtcacgtccaaaagacttgtcagcaccagcacc

SEQ ID NO: 246 - DNA, 200 bp, Amaranthus palmeri
gaatagctacctccacttgcccctgcagtgggaattccaagttggcccaagtgttggtattgaagctggagatcatatctggtgtgcgagatatattcttgaggtactctcctgatagttttatgtttgtcgattttgtgttaaattgtggtaaaccataaagtacatttgtttaattaaaaatttggccttagtggtta

SEQ ID NO: 247 - DNA, 200 bp, Amaranthus palmeri
taaccactaaggccaaatttttaattaaacaaatgtactttatggtttaccacaatttaacacaaaatcgacaaacataaaactatcaggagagtacctcaagaatatatctcgcacaccagatatgatctccagcttcaataccaacacttgggccaacttggaattcccactgcaggggcaagtggaggtagctattc

SEQ ID NO: 248 - DNA, 200 bp, Amaranthus palmeri
attaaaaatttggccttagtggttaaaattatataattaaccttcaaactaataagtcaatagatttgacattgaagttgtggctgatcaagatcaaactaggaccatattatgatggaaacaaaaacataattttgacccatattcggtatgcgattgattcaatcaagaaacttaatggactttcgaaagtaaataaa

SEQ ID NO: 249 - DNA, 200 bp, Amaranthus palmeri
tttatttactttcgaaagtccattaagtttcttgattgaatcaatcgcataccgaatatgggtcaaaattatgtttttgtttccatcataatatggtcctagtttgatcttgatcagccacaacttcaatgtcaaatctattgacttattagtttgaaggttaattatataattttaaccactaaggccaaatttttaat

SEQ ID NO: 250 - DNA, 200 bp, Amaranthus palmeri
taatggactttcgaaagtaaataaaataatccttctttatgaagaaaatttgaatacaggtttataagtgatccaaattcaagcccaatcaatggaagaaagcctattacacttctaggaacatagacacggcagttttcttatagaatgttattgactcatcgagagttgcaattaaacttggttgttcaacaagatta

SEQ ID NO: 251 - DNA, 200 bp, Amaranthus palmeri
taatcttgttgaacaaccaagtttaattgcaactctcgatgagtcaataacattctataagaaaactgccgtgtctatgttcctagaagtgtaataggctttcttccattgattgggcttgaatttggatcacttataaacctgtattcaaattttcttcataaagaaggattattttatttactttcgaaagtccatta

SEQ ID NO: 252 - DNA, 200 bp, Amaranthus palmeri
taaacttggttgttcaacaagattaagctacatgtcttttggttttgtatgggatgcaccgtaaattctggtttttcctatgaccctcacaagccaagcctattgaggggatcagatctcagttcttttaatgattgtatactctgtagaaaaattgaggagatatcaccatttacaagctattttcattgaatttaaca

SEQ ID NO: 253 - DNA, 200 bp, Amaranthus palmeri
tgttaaattcaatgaaaatagcttgtaaatggtgatatctcctcaatttttctacagagtatacaatcattaaaagaactgagatctgatcccctcaataggcttggcttgtgagggtcataggaaaaaccagaatttacggtgcatcccatacaaaaccaaaagacatgtagcttaatcttgttgaacaaccaagttta

SEQ ID NO: 254 - DNA, 200 bp, Amaranthus palmeri
caagctattttcattgaatttaacaagttttctctccttcaaacagagaattactgaacaagctggtgtggttttgactcttgatccaaagcctattgaggtaccgccttgtgcttttgtatatgtaatgatcagctgtctttcctgaagaaccagactgaattcctctccaatatctgcctttttcaacagggtgattg

SEQ ID NO: 255 - DNA, 200 bp, Amaranthus palmeri
caatcaccctgttgaaaaaggcagatattggagaggaattcagtctggttcttcaggaaagacagctgatcattacatatacaaaagcacaaggcggtacctcaataggctttggatcaagagtcaaaaccacaccagcttgttcagtaattctctgtttgaaggagagaaaacttgttaaattcaatgaaaatagcttg

SEQ ID NO: 256 - DNA, 200 bp, Amaranthus palmeri
tctgcctttttcaacagggtgattggaatggtgcaggttgccatacaaattacaggtatctcgaatgttttaaatattttatactggttataatacacgtagcccttgaacaggatatattactcgaaatggtattaaatttgtaattcatggcaaaccacacgtcaatttattttgtaaataacaaatatctcttcttt

SEQ ID NO: 257 - DNA, 200 bp, Amaranthus palmeri
aaagaagagatatttgttatttacaaaataaattgacgtgtggtttgccatgaattacaaatttaataccatttcgagtaatatatcctgttcaagggctacgtgtattataaccagtataaaatatttaaaacattcgagatacctgtaatttgtatggcaacctgcaccattccaatcaccctgttgaaaaaggcaga

SEQ ID NO: 258 - DNA, 200 bp, Amaranthus palmeri
tgtaaataacaaatatctcttcttttagcttcttatgcatattccttagtgcaacaaatatcatttgccttttgttttagtactaatatatgttactgattttgtaagacattatgggatatccgtgtaaatgtagcacagtatctaatgaatcagcatccaagtgttcgaattttggttaactgcctcaaatctgattt

SEQ ID NO: 259 - DNA, 200 bp, Amaranthus palmeri
aaatcagatttgaggcagttaaccaaaattcgaacacttggatgctgattcattagatactgtgctacatttacacggatatcccataatgtcttacaaaatcagtaacatatattagtactaaaacaaaaggcaaatgatatttgttgcactaaggaatatgcataagaagctaaaagaagagatatttgttatttaca

SEQ ID NO: 260 - DNA, 200 bp, Amaranthus palmeri
tggttaactgcctcaaatctgatttttctgttggcgctcaaccaaaattgtaaaatgaatgatgttctcatgtacacgctagcctgtagcttcagccacaagtttgaacgagctacccatattttctcactgtacctttttgatatagattttatgctccgtataaccaatatttctgagatatgagatgaggcctatct

SEQ ID NO: 261 - DNA, 200 bp, Amaranthus palmeri
agataggcctcatctcatatctcagaaatattggttatacggagcataaaatctatatcaaaaaggtacagtgagaaaatatgggtagctcgttcaaacttgtggctgaagctacaggctagcgtgtacatgagaacatcattcattttacaattttggttgagcgccaacagaaaaatcagatttgaggcagttaacca

SEQ ID NO: 262 - DNA, 200 bp, Amaranthus palmeri
ctgagatatgagatgaggcctatctagtgtggggtggataaaaagattttcaccgcaattctttttaaagcgttagtaacactaacatagaccttttaaactattcttgtaagcgtaagtactgtagttgagttgaaacattccgagagcttaattgtctcattttgccaacgctaagaaaattgatgagcaaggttgta

SEQ ID NO: 263 - DNA, 200 bp, Amaranthus palmeri
tacaaccttgctcatcaattttcttagcgttggcaaaatgagacaattaagctctcggaatgtttcaactcaactacagtacttacgcttacaagaatagtttaaaaggtctatgttagtgttactaacgctttaaaaagaattgcggtgaaaatctttttatccaccccacactagataggcctcatctcatatctcag

SEQ ID NO: 264 - DNA, 200 bp, Amaranthus palmeri
aagaaaattgatgagcaaggttgtaatttttgtagtacaaagaccatgagagaagatggtggttatgaagcaattaagaaggcaattttgaatctttcattacgccacaaggaccatatcagtgcatatggagaaggaaatgaacgaaggttgacagggaagcacgagaccgccagcattgacacattctcttgggtata

SEQ ID NO: 265 - DNA, 200 bp, Amaranthus palmeri
tatacccaagagaatgtgtcaatgctggcggtctcgtgcttccctgtcaaccttcgttcatttccttctccatatgcactgatatggtccttgtggcgtaatgaaagattcaaaattgccttcttaattgcttcataaccaccatcttctctcatggtctttgtactacaaaaattacaaccttgctcatcaattttctt

SEQ ID NO: 266 - DNA, 200 bp, Amaranthus palmeri
gcattgacacattctcttgggtatactgatatatatgcctattcttgacgtcatgttgaatatattattttgcatattatctaacaaaaatatgattttttttgtaactttcagggtgttgccaatcgtggttgctctatccgtgtgggtcgtgacacggaaaaggcaggaaaaggtaatattattctctcgttggaaga

SEQ ID NO: 267 - DNA, 200 bp, Amaranthus palmeri
tcttccaacgagagaataatattaccttttcctgccttttccgtgtcacgacccacacggatagagcaaccacgattggcaacaccctgaaagttacaaaaaaaatcatatttttgttagataatatgcaaaataatatattcaacatgacgtcaagaataggcatatatatcagtatacccaagagaatgtgtcaatgc

SEQ ID NO: 268 - DNA, 200 bp, Amaranthus palmeri
gtaatattattctctcgttggaagactatgactgtctcacattgtcgttgtctgtagtaagtaatgtccaaatataaaatcatcatcatacccaatatcccgctcgaaagcagggttgggtgagggaaggtgacggacaatccatacccgtaatcccttcacagggaggactagaacatactactcatttacacatcttg

SEQ ID NO: 269 - DNA, 200 bp, Amaranthus palmeri
caagatgtgtaaatgagtagtatgttctagtcctccctgtgaagggattacgggtatggattgtccgtcaccttccctcacccaaccctgctttcgagcgggatattgggtatgatgatgattttatatttggacattacttactacagacaacgacaatgtgagacagtcatagtcttccaacgagagaataatattac

SEQ ID NO: 270 - DNA, 200 bp, Amaranthus palmeri
acatactactcatttacacatcttgaatgaagcagtctcgtttcatggggtgacatcataatagtcggatataaagcaatatttatgatttccaaggtttgatttctctacaggttatctggaagatagacggcctgcctcaaacatggacccatacgtggtaacaggtttgctcgcagaaactacaatactttgggagc

SEQ ID NO: 271 - DNA, 200 bp, Amaranthus palmeri
gctcccaaagtattgtagtttctgcgagcaaacctgttaccacgtatgggtccatgtttgaggcaggccgtctatcttccagataacctgtagagaaatcaaaccttggaaatcataaatattgctttatatccgactattatgatgtcaccccatgaaacgagactgcttcattcaagatgtgtaaatgagtagtatgt

SEQ ID NO: 272 - DNA, 200 bp, Amaranthus palmeri
gcagaaactacaatactttgggagccaacacttgaggctgaggcactcgcagcccaaaaactcgcccttaatgtgtaattcattcataaatcgtaccagagtatcgcatattcatgaacgagggaactctttcacgcgcccagaattcgcttttttttagtttttagtatcctgggtatgtgagtgttttcatttgtgac

SEQ ID NO: 273 - DNA, 200 bp, Amaranthus palmeri
gtcacaaatgaaaacactcacatacccaggatactaaaaactaaaaaaaagcgaattctgggcgcgtgaaagagttccctcgttcatgaatatgcgatactctggtacgatttatgaatgaattacacattaagggcgagtttttgggctgcgagtgcctcagcctcaagtgttggctcccaaagtattgtagtttctgc

SEQ ID NO: 274 - DNA, 200 bp, Amaranthus palmeri
gtatgtgagtgttttcatttgtgacctttgcttctgatcattgtttgttttgggagttcaagagaagaataatttgtaacagttgccttctttatttttgctcttatgaagctcaagctcagtattagttatattccagattaaggaatgaacttcaaaatcctttgttactcatcttcaactccattgaatatacactt

SEQ ID NO: 275 - DNA, 200 bp, Amaranthus palmeri
aagtgtatattcaatggagttgaagatgagtaacaaaggattttgaagttcattccttaatctggaatataactaatactgagcttgagcttcataagagcaaaaataaagaaggcaactgttacaaattattcttctcttgaactcccaaaacaaacaatgatcagaagcaaaggtcacaaatgaaaacactcacatac

SEQ ID NO: 276 - DNA, 200 bp, Amaranthus palmeri
attattccacactccacactacccatttcattctgctcgctctccttccttctttctcactcctttatctctctatattcatctctctctctagcttgttcacgacgccgaccacccttttccgatcccaggtaaaagtgaccaaacatggcacaaatacttgcaccttacatgcaatgtcagatgaagttttcaaaagg

SEQ ID NO: 277 - DNA, 200 bp, Amaranthus palmeri
ccttttgaaaacttcatctgacattgcatgtaaggtgcaagtatttgtgccatgtttggtcacttttacctgggatcggaaaagggtggtcggcgtcgtgaacaagctagagagagagatgaatatagagagataaaggagtgagaaagaaggaaggagagcgagcagaatgaaatgggtagtgtggagtgtggaataat

SEQ ID NO: 278 - DNA, 200 bp, Amaranthus palmeri
aatgtcagatgaagttttcaaaaggctccacaagttcaatgacatcaaatccttggacttcaatatttcttaaagaaaataaaaagggatcaattaaatgctctagtaagttcagagtatgtgcttctctccaatctgataatagcacagtaaacagggtggagcagctactcaacttggatgtcactccatacactgac

SEQ ID NO: 279 - DNA, 200 bp, Amaranthus palmeri
gtcagtgtatggagtgacatccaagttgagtagctgctccaccctgtttactgtgctattatcagattggagagaagcacatactctgaacttactagagcatttaattgatccctttttattttctttaagaaatattgaagtccaaggatttgatgtcattgaacttgtggagccttttgaaaacttcatctgacatt

SEQ ID NO: 280 - DNA, 200 bp, Amaranthus palmeri
cttggatgtcactccatacactgacaagataattgcagagtacatttggattggaggatctggcattgatgttcgtagcaaatcaaggacaatctctaaacctgttgagcacccatctgagcttcccaagtggaattatgatggctcaagcactggacaagcgccaggagaggacagtgaagtaatcttataccctcaag

SEQ ID NO: 281 - DNA, 200 bp, Amaranthus palmeri
cttgagggtataagattacttcactgtcctctcctggcgcttgtccagtgcttgagccatcataattccacttgggaagctcagatgggtgctcaacaggtttagagattgtccttgatttgctacgaacatcaatgccagatcctccaatccaaatgtactctgcaattatcttgtcagtgtatggagtgacatccaag

SEQ ID NO: 282 - DNA, 200 bp, Amaranthus palmeri
agtgaagtaatcttataccctcaagcaattttcaaggatccattccgtggtggtaataatatccttgtaatctgtgacacatacacaccagcaggcgaacccatccccactaataaaagatacagggctgcacagatctttagcgacccaaaggttgtttctgagattccatggtttggaatagagcaggaatacacgtt

SEQ ID NO: 283 - DNA, 200 bp, Amaranthus palmeri
aacgtgtattcctgctctattccaaaccatggaatctcagaaacaacctttgggtcgctaaagatctgtgcagccctgtatcttttattagtggggatgggttcgcctgctggtgtgtatgtgtcacagattacaaggatattattaccaccacggaatggatccttgaaaattgcttgagggtataagattacttcact

SEQ ID NO: 284 - DNA, 200 bp, Amaranthus palmeri
ttggaatagagcaggaatacacgttgctccaacaaaatgttaaatggcctttgggatggcctgtgggagcctatcctggtcctcagggtccatactattgtggtgctggtgctgacaaatcttttggacgtgacatatctgatgctcattacaaagcttgcttgtatgctggcatcaacattagtggcacaaatggggaa

SEQ ID NO: 285 - DNA, 200 bp, Amaranthus palmeri
ttccccatttgtgccactaatgttgatgccagcatacaagcaagctttgtaatgagcatcagatatgtcacgtccaaaagatttgtcagcaccagcaccacaatagtatggaccctgaggaccaggataggctcccacaggccatcccaaaggccatttaacattttgttggagcaacgtgtattcctgctctattccaa

SEQ ID NO: 286 - DNA, 200 bp, Amaranthus palmeri
caacattagtggcacaaatggggaagttatgcctggccagtgggaattccaagttggcccaagtgttggtattgaagctggagatcatatctggtgtgcgagatatattcttgagagaattactgaacaagctggtgtggttctgactcttgatccaaagcctattgagggtgattggaacggtgcaggttgccatacca

SEQ ID NO: 287 - DNA, 200 bp, Amaranthus palmeri
tggtatggcaacctgcaccgttccaatcaccctcaataggctttggatcaagagtcagaaccacaccagcttgttcagtaattctctcaagaatatatctcgcacaccagatatgatctccagcttcaataccaacacttgggccaacttggaattcccactggccaggcataacttccccatttgtgccactaatgttg

SEQ ID NO: 288 - DNA, 200 bp, Amaranthus palmeri
tggaacggtgcaggttgccataccaattacagtacaaagaccatgagagaagatggtggttatgaagcaattaagaaggcaattttgaatctttcattacgccacaaggaccatatcagtgcatatggagaaggaaatgaacgaaggttgacagggaagcacgagaccgccagcatcgacacattctcttggggtgttgc

SEQ ID NO: 289 - DNA, 200 bp, Amaranthus palmeri
gcaacaccccaagagaatgtgtcgatgctggcggtctcgtgcttccctgtcaaccttcgttcatttccttctccatatgcactgatatggtccttgtggcgtaatgaaagattcaaaattgccttcttaattgcttcataaccaccatcttctctcatggtctttgtactgtaattggtatggcaacctgcaccgttcca

SEQ ID NO: 290 - DNA, 200 bp, Amaranthus palmeri
tcgacacattctcttggggtgttgccaatcgtggttgctctatccgtgtgggtcgtgacacggaaaaggcaggaaaaggttatctggaagatagacggcctgcctcaaacatggacccatacgtggtaacaggtttgctcgcagaaactacaatactttgggagccaacacttgaggctgaggcactcgcagcccaaaaa

SEQ ID NO: 291 - DNA, 200 bp, Amaranthus palmeri
tttttgggctgcgagtgcctcagcctcaagtgttggctcccaaagtattgtagtttctgcgagcaaacctgttaccacgtatgggtccatgtttgaggcaggccgtctatcttccagataaccttttcctgccttttccgtgtcacgacccacacggatagagcaaccacgattggcaacaccccaagagaatgtgtcga

SEQ ID NO: 292 - DNA, 200 bp, Amaranthus palmeri
ggctgaggcactcgcagcccaaaaactcgctcttaatgtgtaattcattcataaatcgtaccagagtatcgcatattcatgaacgagggaactctttcacgtgcccagaattcgcttatttttagtttttagtatcctgggtatgtgagtgttttcattcatgacatttgcttccgatcattgtttgttttgggaattct

SEQ ID NO: 293 - DNA, 200 bp, Amaranthus palmeri
agaattcccaaaacaaacaatgatcggaagcaaatgtcatgaatgaaaacactcacatacccaggatactaaaaactaaaaataagcgaattctgggcacgtgaaagagttccctcgttcatgaatatgcgatactctggtacgatttatgaatgaattacacattaagagcgagtttttgggctgcgagtgcctcagcc

SEQ ID NO: 294 - DNA, 200 bp, Amaranthus palmeri
catgtaaaaatcaatgtgaacacaaaacccgattttgaacctacccgaaacacctgaccctaaatcaactcgatgacccgaatgaacatctgtaggtgggagtaacaatcacgttttatgagtccatttcccctttaggatattgttttctctatttggctttcccaaaaagtcaatgcttggctttagattgatacaaa

SEQ ID NO: 295 - DNA, 200 bp, Amaranthus palmeri
tttgtatcaatctaaagccaagcattgactttttgggaaagccaaatagagaaaacaatatcctaaaggggaaatggactcataaaacgtgattgttactcccacctacagatgttcattcgggtcatcgagttgatttagggtcaggtgtttcgggtaggttcaaaatcgggttttgtgttcacattgatttttacatg

SEQ ID NO: 296 - DNA, 200 bp, Amaranthus palmeri
atgcttggctttagattgatacaaacaatgagcatgcatgtgagtgacagaatgagtagacacaaacaagaaccctaattaaatatctaaatcattacatacaatttgattttccattaatttagtccagagattcttttgcattctccaaatcttgttcagattgtttattcaccactcaatttcagcatccctatcct

SEQ ID NO: 297 - DNA, 200 bp, Amaranthus palmeri
aggatagggatgctgaaattgagtggtgaataaacaatctgaacaagatttggagaatgcaaaagaatctctggactaaattaatggaaaatcaaattgtatgtaatgatttagatatttaattagggttcttgtttgtgtctactcattctgtcactcacatgcatgctcattgtttgtatcaatctaaagccaagcat

SEQ ID NO: 298 - DNA, 200 bp, Amaranthus palmeri
cactcaatttcagcatccctatcctctatggaagagccacacttcattttcaaccattattccacactccacactacccatttcattctgcttactctccttccttctttctcactcctttatctctctatattcatctttctctctctagtttgttcacgacgccgaccacccttttccgatcccaggttctgctgttt

SEQ ID NO: 299 - DNA, 200 bp, Amaranthus palmeri
aaacagcagaacctgggatcggaaaagggtggtcggcgtcgtgaacaaactagagagagaaagatgaatatagagagataaaggagtgagaaagaaggaaggagagtaagcagaatgaaatgggtagtgtggagtgtggaataatggttgaaaatgaagtgtggctcttccatagaggatagggatgctgaaattgagtg

SEQ ID NO: 300 - DNA, 200 bp, Amaranthus palmeri
tttccgatcccaggttctgctgtttatttagctttttttggttatgtttgcaattgactgttgtgctgcttgtagtatcagatttgtggaattatcagtgttttgtgtttgtgtgttgaaacatggcaaatgggtttgcattgtgttaattttttcttactcggattgacattgaccgatcaactcattaccgctaaaac

SEQ ID NO: 301 - DNA, 200 bp, Amaranthus palmeri
gttttagcggtaatgagttgatcggtcaatgtcaatccgagtaagaaaaaattaacacaatgcaaacccatttgccatgtttcaacacacaaacacaaaacactgataattccacaaatctgatactacaagcagcacaacagtcaattgcaaacataaccaaaaaaagctaaataaacagcagaacctgggatcggaaa

SEQ ID NO: 302 - DNA, 200 bp, Amaranthus palmeri
ccgatcaactcattaccgctaaaacacccttttttttaatggtggaatggcatttgttaaatgttagtcgttttggtatagtagcttcagattaagactgcataatgtttactggagctgtattaagatgctatattagggtttttgctacacttgaacatgggtaaatggtacccaattggttgaaacttgaaactagg

SEQ ID NO: 303 - DNA, 200 bp, Amaranthus palmeri
cctagtttcaagtttcaaccaattgggtaccatttacccatgttcaagtgtagcaaaaaccctaatatagcatcttaatacagctccagtaaacattatgcagtcttaatctgaagctactataccaaaacgactaacatttaacaaatgccattccaccattaaaaaaaagggtgttttagcggtaatgagttgatcgg

SEQ ID NO: 304 - DNA, 200 bp, Amaranthus palmeri
caattggttgaaacttgaaactaggatatttcaattgtgatttttccctttgtttgactttccccggatgctttgtgggttgatattggcgtggtaatggggaagatcaattgttttaggatcaggatttaggtattcattacctctaaactccctttatggtatgatttgtcgccttccttccctttccagaccctgat

SEQ ID NO: 305 - DNA, 200 bp, Amaranthus palmeri
atcagggtctggaaagggaaggaaggcgacaaatcataccataaagggagtttagaggtaatgaatacctaaatcctgatcctaaaacaattgatcttccccattaccacgccaatatcaacccacaaagcatccggggaaagtcaaacaaagggaaaaatcacaattgaaatatcctagtttcaagtttcaaccaattg

SEQ ID NO: 306 - DNA, 200 bp, Amaranthus palmeri
cttccttccctttccagaccctgatcatagtttccttatgagtgggatacactagtcaagatgatcatgatgatgatgataattttagctattccttgtgctagagtcattgatcagtgttacaaatttcccaaacaaatttgatgagatggaagataattattaaagctacattttgtcggaatactattgaaattaat

SEQ ID NO: 307 - DNA, 200 bp, Amaranthus palmeri
attaatttcaatagtattccgacaaaatgtagctttaataattatcttccatctcatcaaatttgtttgggaaatttgtaacactgatcaatgactctagcacaaggaatagctaaaattatcatcatcatcatgatcatcttgactagtgtatcccactcataaggaaactatgatcagggtctggaaagggaaggaag

SEQ ID NO: 308 - DNA, 200 bp, Amaranthus palmeri
ttgtcggaatactattgaaattaatcacttgttagaatatgtaagtaggttattacattactaatcacttgttaatgtcattttaatatggagggagtatggttttgtggttttcctagctaacaatctatacctgcggtcctgctggctatttctttccaggctcatgttagtatagtgtataagtggccccaacttat

SEQ ID NO: 309 - DNA, 200 bp, Amaranthus palmeri
ataagttggggccacttatacactatactaacatgagcctggaaagaaatagccagcaggaccgcaggtatagattgttagctaggaaaaccacaaaaccatactccctccatattaaaatgacattaacaagtgattagtaatgtaataacctacttacatattctaacaagtgattaatttcaatagtattccgacaa

SEQ ID NO: 310 - DNA, 200 bp, Amaranthus palmeri
tagtgtataagtggccccaacttatcagaaagatggattttggcattaactatgtgactatgtccaagtatattgaacacttttatttctagtttcatttatctcctgtacttatttgagacctgctcttgtgcttcatataaaaaattacacaaaggttacaaaacactgttggactaaaacataaggaactcgccttt

SEQ ID NO: 311 - DNA, 200 bp, Amaranthus palmeri
aaaggcgagttccttatgttttagtccaacagtgttttgtaacctttgtgtaattttttatatgaagcacaagagcaggtctcaaataagtacaggagataaatgaaactagaaataaaagtgttcaatatacttggacatagtcacatagttaatgccaaaatccatctttctgataagttggggccacttatacacta

SEQ ID NO: 312 - DNA, 200 bp, Amaranthus palmeri
actaaaacataaggaactcgcctttacaacaattgaaattttctcatctcattcatatagtgagctactatttgtgcgcgagcgattaccgaatagtgattacatcatctcttttgcctatgtgtttgtattacttgcatttgcatactcatgtcatgtacatgtggattttcatgctcaaacttgaatactttatgaag

SEQ ID NO: 313 - DNA, 200 bp, Amaranthus palmeri
cttcataaagtattcaagtttgagcatgaaaatccacatgtacatgacatgagtatgcaaatgcaagtaatacaaacacataggcaaaagagatgatgtaatcactattcggtaatcgctcgcgcacaaatagtagctcactatatgaatgagatgagaaaatttcaattgttgtaaaggcgagttccttatgttttagt

SEQ ID NO: 314 - DNA, 200 bp, Amaranthus palmeri
gctcaaacttgaatactttatgaagacatatctgaaacacatgtgcatttgtattaccacatttttttatccaaaatgatattccaaatgtattgtatgtcggggtgcccagcatttaatccaaaagtttcataaaccttgagtgaccgagatgcaaatctgtggcaatctgatctaaaggtttcataaatcctagaatt

SEQ ID NO: 315 - DNA, 200 bp, Amaranthus palmeri
aattctaggatttatgaaacctttagatcagattgccacagatttgcatctcggtcactcaaggtttatgaaacttttggattaaatgctgggcaccccgacatacaatacatttggaatatcattttggataaaaaaatgtggtaatacaaatgcacatgtgtttcagatatgtcttcataaagtattcaagtttgagc

SEQ ID NO: 316 - DNA, 200 bp, Amaranthus palmeri
taaaggtttcataaatcctagaattcaaagcagacatatctgaaacacataaattaacgtgttatgcccatgtactcgaaaatgtttcctggaaactgagattggtttttcaacataagttgactcttgaccattgtgtgtttggttagcaatctacctgagtaacccacatatgtaaaaccctaacatattttatttgt

SEQ ID NO: 317 - DNA, 200 bp, Amaranthus palmeri
acaaataaaatatgttagggttttacatatgtgggttactcaggtagattgctaaccaaacacacaatggtcaagagtcaacttatgttgaaaaaccaatctcagtttccaggaaacattttcgagtacatgggcataacacgttaatttatgtgtttcagatatgtctgctttgaattctaggatttatgaaaccttta

SEQ ID NO: 318 - DNA, 200 bp, Amaranthus palmeri
taaaaccctaacatattttatttgtgttgtaggtaaaagtgaccaaacatggcacaaatacttgcaccttacatgcaatgtcagatgaagttttcaaaaggctccacaagttcaatgacatcaaatccttggacttcaatatttcttaaagaaaataaaaagggatcaattaaatgctctagtaagttcagagtatgtgc

SEQ ID NO: 319 - DNA, 200 bp, Amaranthus palmeri
gcacatactctgaacttactagagcatttaattgatccctttttattttctttaagaaatattgaagtccaaggatttgatgtcattgaacttgtggagccttttgaaaacttcatctgacattgcatgtaaggtgcaagtatttgtgccatgtttggtcacttttacctacaacacaaataaaatatgttagggtttta

SEQ ID NO: 320 - DNA, 200 bp, Amaranthus palmeri
gctctagtaagttcagagtatgtgcttctctccaatctgataatagcacagtaaacagggtggagcagctactcaacttggatgtcactccatacactgacaagataattgcagagtacatttggtatatggttttcctttctataggccagatgtcacattaattttttttagctaatgtttgtgctacttttagtttt

SEQ ID NO: 321 - DNA, 200 bp, Amaranthus palmeri
aaaactaaaagtagcacaaacattagctaaaaaaaattaatgtgacatctggcctatagaaaggaaaaccatataccaaatgtactctgcaattatcttgtcagtgtatggagtgacatccaagttgagtagctgctccaccctgtttactgtgctattatcagattggagagaagcacatactctgaacttactagagc

SEQ ID NO: 322 - DNA, 200 bp, Amaranthus palmeri
taatgtttgtgctacttttagttttttctcatctgtagataagacattcttggtggtttctactttcaatctgattatagaactaattgatctacgattgttctttggaacaggattggaggatctggtattgatgtccgtagcaaatcaagggtacaataacactgatgctgtcgatttattgttaaaccagcatttag

SEQ ID NO: 323 - DNA, 200 bp, Amaranthus palmeri
ctaaatgctggtttaacaataaatcgacagcatcagtgttattgtacccttgatttgctacggacatcaataccagatcctccaatcctgttccaaagaacaatcgtagatcaattagttctataatcagattgaaagtagaaaccaccaagaatgtcttatctacagatgagaaaaaactaaaagtagcacaaacatta

SEQ ID NO: 324 - DNA, 200 bp, Amaranthus palmeri
gatttattgttaaaccagcatttagatgttaagtttacttcattttttccctgaccgatgtttcttaatataccagacaatctctaaacctgttgagcacccatctgagcttcccaagtggaattatgatggctcaagcactggacaagcgccaggagaggacagtgaagtaatcttatagtaagatcttggggcagcta

SEQ ID NO: 325 - DNA, 200 bp, Amaranthus palmeri
tagctgccccaagatcttactataagattacttcactgtcctctcctggcgcttgtccagtgcttgagccatcataattccacttgggaagctcagatgggtgctcaacaggtttagagattgtctggtatattaagaaacatcggtcagggaaaaaatgaagtaaacttaacatctaaatgctggtttaacaataaatc

SEQ ID NO: 326 - DNA, 200 bp, Amaranthus palmeri
ttatagtaagatcttggggcagctataaacctttattactttgctcaattattgttgtccttgtttttgcttgactatcttttggggcttgagagttcttgtcactgaactaactcaaaaagcttaagctttcatttgagtcgattccttgacatggtatgggaaggttagcttacgggtttgaatctcatttaccctcc

SEQ ID NO: 327 - DNA, 200 bp, Amaranthus palmeri
ggagggtaaatgagattcaaacccgtaagctaaccttcccataccatgtcaaggaatcgactcaaatgaaagcttaagctttttgagttagttcagtgacaagaactctcaagccccaaaagatagtcaagcaaaaacaaggacaacaataattgagcaaagtaataaaggtttatagctgccccaagatcttactataa

SEQ ID NO: 328 - DNA, 200 bp, Amaranthus palmeri
cgggtttgaatctcatttaccctccgggaattattattactaagtaaatgtgtcgtgtccacacttctagttagggctttcgtgtgagggggcgtagtaggacctcaaccatcaacttaagatttatttgagttgattcctagaaaattcttgtcactcattaattcgtaatcatgtcattcatatgcagccctcaagca

SEQ ID NO: 329 - DNA, 200 bp, Amaranthus palmeri
tgcttgagggctgcatatgaatgacatgattacgaattaatgagtgacaagaattttctaggaatcaactcaaataaatcttaagttgatggttgaggtcctactacgccccctcacacgaaagccctaactagaagtgtggacacgacacatttacttagtaataataattcccggagggtaaatgagattcaaacccg

SEQ ID NO: 330 - DNA, 200 bp, Amaranthus palmeri
gtcattcatatgcagccctcaagcaattttcaaggatccattccgtggtggtaataatatccttgtgagtcatattctttctgactgttgtgaaactcaatatttattccaaaattatgatgttacctcaattgttgagattagaattttaattatgcattgccatgtaaatttaggtaatctgtgacacatacacacca

SEQ ID NO: 331 - DNA, 200 bp, Amaranthus palmeri
tggtgtgtatgtgtcacagattacctaaatttacatggcaatgcataattaaaattctaatctcaacaattgaggtaacatcataattttggaataaatattgagtttcacaacagtcagaaagaatatgactcacaaggatattattaccaccacggaatggatccttgaaaattgcttgagggctgcatatgaatgac

SEQ ID NO: 332 - DNA, 200 bp, Amaranthus palmeri
ggtaatctgtgacacatacacaccagcaggcgaacccatccccactaataaaagatacagggctgcacagatctttagcgacccaaaggttgtttctgagattccatggtaagaaattcccatcattgacaatattttgttcctaatcatatttcctaatttaacactctccactgcaagggtgaactttatagaaagtt

SEQ ID NO: 333 - DNA, 200 bp, Amaranthus palmeri
aactttctataaagttcacccttgcagtggagagtgttaaattaggaaatatgattaggaacaaaatattgtcaatgatgggaatttcttaccatggaatctcagaaacaacctttgggtcgctaaagatctgtgcagccctgtatcttttattagtggggatgggttcgcctgctggtgtgtatgtgtcacagattacc

SEQ ID NO: 334 - DNA, 200 bp, Amaranthus palmeri
gcaagggtgaactttatagaaagttgacccactatctgagaaatgacaaattaaaaactgatttctctagttttctaataaaagacaatgcataaattatgtgatggataccactaagggaataacctcaccaaagttcacttaaatttgaaggttaaattgtgggatgtacaatctaaactctcaatgtttcttttgga

SEQ ID NO: 335 - DNA, 200 bp, Amaranthus palmeri
tccaaaagaaacattgagagtttagattgtacatcccacaatttaaccttcaaatttaagtgaactttggtgaggttattcccttagtggtatccatcacataatttatgcattgtcttttattagaaaactagagaaatcagtttttaatttgtcatttctcagatagtgggtcaactttctataaagttcacccttgc

SEQ ID NO: 336 - DNA, 200 bp, Amaranthus palmeri
ctaaactctcaatgtttcttttggattctagggaatgcttatccaagcttaaaactgatctttttgaattttgagtaagattgaactccgaattcattcaaaattttcaagagctcgtcaatattacaactcaagctttgacaaaatcaaaacaatcattcgtgtaaacacaatgaatttgtttaaggtgttcaactttg

SEQ ID NO: 337 - DNA, 200 bp, Amaranthus palmeri
caaagttgaacaccttaaacaaattcattgtgtttacacgaatgattgttttgattttgtcaaagcttgagttgtaatattgacgagctcttgaaaattttgaatgaattcggagttcaatcttactcaaaattcaaaaagatcagttttaagcttggataagcattccctagaatccaaaagaaacattgagagtttag

SEQ ID NO: 338 - DNA, 200 bp, Amaranthus palmeri
aatttgtttaaggtgttcaactttgtattctctaaataatgcatacaacctagggccccaggctacttcaacgagaacatacctctagtccgactcttactaggaatttcctaaataatgctaaatcaaatatcttctggattgatttagctgcaagtatcaaacaatatattactattactcgaattaaaaagtaatcc

SEQ ID NO: 339 - DNA, 200 bp, Amaranthus palmeri
ggattactttttaattcgagtaatagtaatatattgtttgatacttgcagctaaatcaatccagaagatatttgatttagcattatttaggaaattcctagtaagagtcggactagaggtatgttctcgttgaagtagcctggggccctaggttgtatgcattatttagagaatacaaagttgaacaccttaaacaaatt

SEQ ID NO: 340 - DNA, 200 bp, Amaranthus palmeri
tattactcgaattaaaaagtaatcctacccttatccggagtgtaaaaatatccggctatcctgtaagaaaaccataacctaaacctacgtctactaggatatggtcaaactatgaagaagcttccaaggatatttgacatggatagaactttgacttttaactcatacaagccaacatcactttgcaaacaagtgaataa

SEQ ID NO: 341 - DNA, 200 bp, Amaranthus palmeri
ttattcacttgtttgcaaagtgatgttggcttgtatgagttaaaagtcaaagttctatccatgtcaaatatccttggaagcttcttcatagtttgaccatatcctagtagacgtaggtttaggttatggttttcttacaggatagccggatatttttacactccggataagggtaggattactttttaattcgagtaata

SEQ ID NO: 342 - DNA, 200 bp, Amaranthus palmeri
catcactttgcaaacaagtgaataaatgatccaagctgggactacggagaggacaaaatgcgcacttgttcacattagaaaaattactaacaggaagtattcatttgaacaagctaggacttcaagtaatgcctttgatcttgtgtcaatggttagcagtcgtaatacagtatgtcacacttgtaattaacataacaaat

SEQ ID NO: 343 - DNA, 200 bp, Amaranthus palmeri
atttgttatgttaattacaagtgtgacatactgtattacgactgctaaccattgacacaagatcaaaggcattacttgaagtcctagcttgttcaaatgaatacttcctgttagtaatttttctaatgtgaacaagtgcgcattttgtcctctccgtagtcccagcttggatcatttattcacttgtttgcaaagtgatg

SEQ ID NO: 344 - DNA, 200 bp, Amaranthus palmeri
cacacttgtaattaacataacaaatctgttgttttaaatatgacggtttgaatacccatgttctacgggaggcatttcactataaaggtcaaccgtttttgcctagtttggagcttgacaattgcaaaagtaattcaggggtctgcttttctagaattctggatcattatgagtctcttctgctctttgttttcgccttt

SEQ ID NO: 345 - DNA, 200 bp, Amaranthus palmeri
aaaggcgaaaacaaagagcagaagagactcataatgatccagaattctagaaaagcagacccctgaattacttttgcaattgtcaagctccaaactaggcaaaaacggttgacctttatagtgaaatgcctcccgtagaacatgggtattcaaaccgtcatatttaaaacaacagatttgttatgttaattacaagtgtg

SEQ ID NO: 346 - DNA, 200 bp, Amaranthus palmeri
tcttctgctctttgttttcgcctttcttttttcactctctagtctctacttttgggtttattctttatattatacttttgtaggtttggaatagagcaggaatacactttgctccaacaaaatgttaaatggcctttgggatggcctgtgggagcatatcctggtcctcaggtgtgttaattccccatattatcaacagt

SEQ ID NO: 347 - DNA, 200 bp, Amaranthus palmeri
actgttgataatatggggaattaacacacctgaggaccaggatatgctcccacaggccatcccaaaggccatttaacattttgttggagcaaagtgtattcctgctctattccaaacctacaaaagtataatataaagaataaacccaaaagtagagactagagagtgaaaaaagaaaggcgaaaacaaagagcagaaga

SEQ ID NO: 348 - DNA, 200 bp, Amaranthus palmeri
gttaattccccatattatcaacagtttctttgaagataatgctttgtttctgttatataatatgatttttttgatatgtctagggtccatactattgtggtgctggtgctgacaagtcttttggacgtgacatatctgatgctcattacaaagcttgcttgtatgctggcatcaacattagtggcacaaatggggaagtt

SEQ ID NO: 349 - DNA, 200 bp, Amaranthus palmeri
aacttccccatttgtgccactaatgttgatgccagcatacaagcaagctttgtaatgagcatcagatatgtcacgtccaaaagacttgtcagcaccagcaccacaatagtatggaccctagacatatcaaaaaaatcatattatataacagaaacaaagcattatcttcaaagaaactgttgataatatggggaattaac

SEQ ID NO: 350 - DNA, 200 bp, Amaranthus palmeri
cattagtggcacaaatggggaagttatgcctggccaggtgtcctctcgtatcattcttatgtcttattgctatttaatatgtctttgaagttggttatgaatagctacatctgcttacacctgcagtgggaattccaagttggtccaagtgttggcattgaagctggagatcatatctggtgtgctagatatattcttga

SEQ ID NO: 351 - DNA, 200 bp, Amaranthus palmeri
tcaagaatatatctagcacaccagatatgatctccagcttcaatgccaacacttggaccaacttggaattcccactgcaggtgtaagcagatgtagctattcataaccaacttcaaagacatattaaatagcaataagacataagaatgatacgagaggacacctggccaggcataacttccccatttgtgccactaatg

SEQ ID NO: 352 - DNA, 200 bp, Amaranthus palmeri
tctggtgtgctagatatattcttgaggtattctcctgaaatttgtatgtttgcccctttcaagttatattgtggcaactttgagtacattcgaatgatcaggaattcagtcttagtggttaattttataatttttactaagagaactgataaattaatcgacctgacattgaaattgtgcgtgattctctgatcaaatgg

SEQ ID NO: 353 - DNA, 200 bp, Amaranthus palmeri
ccatttgatcagagaatcacgcacaatttcaatgtcaggtcgattaatttatcagttctcttagtaaaaattataaaattaaccactaagactgaattcctgatcattcgaatgtactcaaagttgccacaatataacttgaaaggggcaaacatacaaatttcaggagaatacctcaagaatatatctagcacaccaga

SEQ ID NO: 354 - DNA, 200 bp, Amaranthus palmeri
tgtgcgtgattctctgatcaaatggggaccacattatgatagaaataatatgcattattatgacccatatttagtctacaattgattcaatcaaaaatccttatggaccagaaaaagaaattgtaataatgattctctaaaaatttagttgaaatgttgaatataggatcaagcgtgatccaaacccaatcaagatggta

SEQ ID NO: 355 - DNA, 200 bp, Amaranthus palmeri
taccatcttgattgggtttggatcacgcttgatcctatattcaacatttcaactaaatttttagagaatcattattacaatttctttttctggtccataaggatttttgattgaatcaattgtagactaaatatgggtcataataatgcatattatttctatcataatgtggtccccatttgatcagagaatcacgcaca

SEQ ID NO: 356 - DNA, 200 bp, Amaranthus palmeri
tgatccaaacccaatcaagatggtataaggtgtcttatcatctatgtttgtgagaaaatgagttgtatcagattaatgggaaacaacggatggaagttgatcacttttaggcacataaacaacaaactttcttatataatgtatatactccttcggatgcgtaattttattcaatcaagctgttcaacaagattaagcta

SEQ ID NO: 357 - DNA, 200 bp, Amaranthus palmeri
tagcttaatcttgttgaacagcttgattgaataaaattacgcatccgaaggagtatatacattatataagaaagtttgttgtttatgtgcctaaaagtgatcaacttccatccgttgtttcccattaatctgatacaactcattttctcacaaacatagatgataagacaccttataccatcttgattgggtttggatca

SEQ ID NO: 358 - DNA, 200 bp, Amaranthus palmeri
caagctgttcaacaagattaagctacatgtccttttgttttgtatgggatgaaccagaaaactctcatctttttatgaccctcacaaaccattaacaatgtctatttatagagcatgtgtgaatcttagggcctaggggtgttaacgagctaaaccaagccaagtcgggctagtgtgagtgctcaacttgacttcatgtt

SEQ ID NO: 359 - DNA, 200 bp, Amaranthus palmeri
aacatgaagtcaagttgagcactcacactagcccgacttggcttggtttagctcgttaacacccctaggccctaagattcacacatgctctataaatagacattgttaatggtttgtgagggtcataaaaagatgagagttttctggttcatcccatacaaaacaaaaggacatgtagcttaatcttgttgaacagcttg

SEQ ID NO: 360 - DNA, 200 bp, Amaranthus palmeri
tgagtgctcaacttgacttcatgtttttcaaactcaagctaaatatttggatgttttagctcaaaatttaagcttcaaatctctatttggtgtgatactttatatatattaagagttaaaaagtttcactaactacatattagaatatgcattcgtattgtataaaactttaataagattttaaaatctatttaaaaacg

SEQ ID NO: 361 - DNA, 200 bp, Amaranthus palmeri
cgtttttaaatagattttaaaatcttattaaagttttatacaatacgaatgcatattctaatatgtagttagtgaaactttttaactcttaatatatataaagtatcacaccaaatagagatttgaagcttaaattttgagctaaaacatccaaatatttagcttgagtttgaaaaacatgaagtcaagttgagcactca

SEQ ID NO: 362 - DNA, 200 bp, Amaranthus palmeri
agattttaaaatctatttaaaaacgattctaattctcaaaacgaatattgataaaaccattttgagtatattcacgagcatatcaagctgaatgagttggtttgcctcttaatcttagtttcttaaatgctcgataagcaccgaggcacacaaggtcctcggagcctaggcgcatatcacaaggcaaaaatgcgagtttt

SEQ ID NO: 363 - DNA, 200 bp, Amaranthus palmeri
aaaactcgcatttttgccttgtgatatgcgcctaggctccgaggaccttgtgtgcctcggtgcttatcgagcatttaagaaactaagattaagaggcaaaccaactcattcagcttgatatgctcgtgaatatactcaaaatggttttatcaatattcgttttgagaattagaatcgtttttaaatagattttaaaatct

SEQ ID NO: 364 - DNA, 200 bp, Amaranthus palmeri
atcacaaggcaaaaatgcgagttttttgtaggcaaggagcaaatcttcactaaaaaaatattaaatatcaaatttaaaacataaatatacttatattcatattataatagcaacaagcttgaaaatattcgttatcattgttgtaaacactaatttagcatataagtgatatgtttgaaaatgtgaaaatacccagttat

SEQ ID NO: 365 - DNA, 200 bp, Amaranthus palmeri
ataactgggtattttcacattttcaaacatatcacttatatgctaaattagtgtttacaacaatgataacgaatattttcaagcttgttgctattataatatgaatataagtatatttatgttttaaatttgatatttaatatttttttagtgaagatttgctccttgcctacaaaaaactcgcatttttgccttgtgat

SEQ ID NO: 366 - DNA, 200 bp, Amaranthus palmeri
tgaaaatgtgaaaatacccagttatattcttcttcttcatgtggttgtctagcctatttattatgcaagcaataatttctcgaacttcatattcaagtgaatttgggtttctatgttttatttattttcaaacaaacaagtttaagttaatgtccaagcccaacaaggaggtgtattgagcgcacatggcccgaaacgcg

SEQ ID NO: 367 - DNA, 200 bp, Amaranthus palmeri
cgcgtttcgggccatgtgcgctcaatacacctccttgttgggcttggacattaacttaaacttgtttgtttgaaaataaataaaacatagaaacccaaattcacttgaatatgaagttcgagaaattattgcttgcataataaataggctagacaaccacatgaagaagaagaatataactgggtattttcacattttca

SEQ ID NO: 368 - DNA, 200 bp, Amaranthus palmeri
ttgagcgcacatggcccgaaacgcgtcgaggcacaccaagatgcgcgcctcttatagtggtttttgcctcaccttgctaaggcgtcttcggccgtgcaaagcaatgcacactttttaaaactaagctcttgataatctgagttgtgctcaaatagtttgcaaatcgtgtgggatcataaatacccctccattaagcagta

SEQ ID NO: 369 - DNA, 200 bp, Amaranthus palmeri
tactgcttaatggaggggtatttatgatcccacacgatttgcaaactatttgagcacaactcagattatcaagagcttagttttaaaaagtgtgcattgctttgcacggccgaagacgccttagcaaggtgaggcaaaaaccactataagaggcgcgcatcttggtgtgcctcgacgcgtttcgggccatgtgcgctcaa

SEQ ID NO: 370 - DNA, 200 bp, Amaranthus palmeri
ataaatacccctccattaagcagtagagattcacaatttcatttcatttgcggtgtatcctcaaatcgctgcacctgtaaaggcagctgaaccaagatctcagttttttattgactgtctagtctgtagaaaaattaagagatatcaccattcaagctattttaattgaatttaacaagctttctctccttcaaacagag

SEQ ID NO: 371 - DNA, 200 bp, Amaranthus palmeri
ctctgtttgaaggagagaaagcttgttaaattcaattaaaatagcttgaatggtgatatctcttaatttttctacagactagacagtcaataaaaaactgagatcttggttcagctgcctttacaggtgcagcgatttgaggatacaccgcaaatgaaatgaaattgtgaatctctactgcttaatggaggggtatttat

SEQ ID NO: 372 - DNA, 200 bp, Amaranthus palmeri
caagctttctctccttcaaacagagaattactgaacaagctggtgtggttctgactcttgatccaaagcctattgaggtactgccttgtccttttgtatttcttatgagcagctgtcttttctaaagaaccagactgaattcctctccaatatctgcttttttcaacagggtgattggaatggtgcaggttgtcatacaa

SEQ ID NO: 373 - DNA, 200 bp, Amaranthus palmeri
ttgtatgacaacctgcaccattccaatcaccctgttgaaaaaagcagatattggagaggaattcagtctggttctttagaaaagacagctgctcataagaaatacaaaaggacaaggcagtacctcaataggctttggatcaagagtcagaaccacaccagcttgttcagtaattctctgtttgaaggagagaaagcttg

SEQ ID NO: 374 - DNA, 200 bp, Amaranthus palmeri
tggaatggtgcaggttgtcatacaaattacaggtatctcgaatgttttaaatattttatactggttataatacacgtagccccttgaacaggatatattactcgaaatggtattaaatttgtaattcatggcaaaccacacgtcaatttattttgtaaatgacaaatacttcttttagcattatggcatatccatcttaa

SEQ ID NO: 375 - DNA, 200 bp, Amaranthus palmeri
ttaagatggatatgccataatgctaaaagaagtatttgtcatttacaaaataaattgacgtgtggtttgccatgaattacaaatttaataccatttcgagtaatatatcctgttcaaggggctacgtgtattataaccagtataaaatatttaaaacattcgagatacctgtaatttgtatgacaacctgcaccattcca

SEQ ID NO: 376 - DNA, 200 bp, Amaranthus palmeri
tagcattatggcatatccatcttaatgcagcacagtacactattgaattagcattccaaaacttcgaatatcgcctggctgtcttaagtacccttatatagacatttaaatctatacttgttactgtaattgctagtgtctatggaattcactatacttcacatagctgagttgaagttgatgttagtgtctgtgatttt

SEQ ID NO: 377 - DNA, 200 bp, Amaranthus palmeri
aaaatcacagacactaacatcaacttcaactcagctatgtgaagtatagtgaattccatagacactagcaattacagtaacaagtatagatttaaatgtctatataagggtacttaagacagccaggcgatattcgaagttttggaatgctaattcaatagtgtactgtgctgcattaagatggatatgccataatgcta

SEQ ID NO: 378 - DNA, 200 bp, Amaranthus palmeri
agttgatgttagtgtctgtgatttttgtagtacaaagaccatgagagaagatggtggttatgaagcaattaagaaggcaattttgaatctatcattacgccacaaggaccatatcagtgcatatggagaaggaaatgaacgaagattgacagggaagcacgagaccgccagcatcgacactttctcttgggtatacagat

SEQ ID NO: 379 - DNA, 200 bp, Amaranthus palmeri
atctgtatacccaagagaaagtgtcgatgctggcggtctcgtgcttccctgtcaatcttcgttcatttccttctccatatgcactgatatggtccttgtggcgtaatgatagattcaaaattgccttcttaattgcttcataaccaccatcttctctcatggtctttgtactacaaaaatcacagacactaacatcaact

SEQ ID NO: 380 - DNA, 200 bp, Amaranthus palmeri
gacactttctcttgggtatacagatatatatgccttttcttgacgtcatgttgaatatattattttgcatattatctaacaaaaatatgattttttttgtaactttcagggtgttgccaatcgtggttgctctatccgtgtgggtcgtgacacggaaaaggcaggaaaaggtaatagtatcctcttggaccttggttaaa

SEQ ID NO: 381 - DNA, 200 bp, Amaranthus palmeri
tttaaccaaggtccaagaggatactattaccttttcctgccttttccgtgtcacgacccacacggatagagcaaccacgattggcaacaccctgaaagttacaaaaaaaatcatatttttgttagataatatgcaaaataatatattcaacatgacgtcaagaaaaggcatatatatctgtatacccaagagaaagtgtc

SEQ ID NO: 382 - DNA, 200 bp, Amaranthus palmeri
agtatcctcttggaccttggttaaagactatgactactgattggatgttctttttgtttgcattttgctccccggatttagaaataactctttctcccatttccgtgctctgcagtgagtaacaaccaaatagaattcactccttccgtttttctcaattcaccgcaccttctatttttgtctatccccacgaaactgcc

SEQ ID NO: 383 - DNA, 200 bp, Amaranthus palmeri
ggcagtttcgtggggatagacaaaaatagaaggtgcggtgaattgagaaaaacggaaggagtgaattctatttggttgttactcactgcagagcacggaaatgggagaaagagttatttctaaatccggggagcaaaatgcaaacaaaaagaacatccaatcagtagtcatagtctttaaccaaggtccaagaggatact

SEQ ID NO: 384 - DNA, 200 bp, Amaranthus palmeri
ttttgtctatccccacgaaactgccccattactattttcggacatgactcactactttaacacatctttactctcgatattctctctcttatttgcaaatgaccccaccattaacccattcaacccaacttttaatcgccgtcccattcccacttggggcaaaatcacaaggacaaaggagtacaaatcaattgcaatcc

SEQ ID NO: 385 - DNA, 200 bp, Amaranthus palmeri
ggattgcaattgatttgtactcctttgtccttgtgattttgccccaagtgggaatgggacggcgattaaaagttgggttgaatgggttaatggtggggtcatttgcaaataagagagagaatatcgagagtaaagatgtgttaaagtagtgagtcatgtccgaaaatagtaatggggcagtttcgtggggatagacaaaa

SEQ ID NO: 386 - DNA, 200 bp, Amaranthus palmeri
aaggagtacaaatcaattgcaatcctggctagttctgatttccaatctccgatttctctgcaggttatctagaagataggcgacctgcctcaaacatggacccatacgtggtaacaggtttgctcgccgaaactacaatactttgggaacccacgcttgaggccgagtcacttgcagctcaaaaactcgctcttaatgtg

SEQ ID NO: 387 - DNA, 200 bp, Amaranthus palmeri
cacattaagagcgagtttttgagctgcaagtgactcggcctcaagcgtgggttcccaaagtattgtagtttcggcgagcaaacctgttaccacgtatgggtccatgtttgaggcaggtcgcctatcttctagataacctgcagagaaatcggagattggaaatcagaactagccaggattgcaattgatttgtactcctt

SEQ ID NO: 388 - DNA, 200 bp, Amaranthus palmeri
agctcaaaaactcgctcttaatgtgtaattccaaccataaaatgaaccagaatatcgcatattcttgagcgaagaaactgtttcatgtgcccagaatttgcttgtttttagtttttagtatcctgggactgagactggcactggggctcaaaaacctttgcttctggtagtttgttttgggagttagaagagaagaatag

SEQ ID NO: 389 - DNA, 200 bp, Amaranthus palmeri
ctattcttctcttctaactcccaaaacaaactaccagaagcaaaggtttttgagccccagtgccagtctcagtcccaggatactaaaaactaaaaacaagcaaattctgggcacatgaaacagtttcttcgctcaagaatatgcgatattctggttcattttatggttggaattacacattaagagcgagtttttgagct

SEQ ID NO: 390 - DNA, 200 bp, Amaranthus rudis
gatttcttaattgaagttcccaaaaacaaataacatactcatcttcctcttctcttattcatccaattttattcttccccaaaaaacatgtctcttcttacagatctcatcaatcttaacctctctgactccactgagaagatcattgctgaatacatatggattggtggatctggtatggacatgagaagtaaagcaag

SEQ ID NO: 391 - DNA, 200 bp, Amaranthus rudis
cttgctttacttctcatgtccataccagatccaccaatccatatgtattcagcaatgatcttctcagtggagtcagagaggttaagattgatgagatctgtaagaagagacatgttttttggggaagaataaaattggatgaataagagaagaggaagatgagtatgttatttgtttttgggaacttcaattaagaaatc

SEQ ID NO: 392 - DNA, 200 bp, Amaranthus rudis
gtatggacatgagaagtaaagcaagaacacttgatgaacctgtgagtgatcctaaaaagcttccaaaatggaattatgatggatctagcactaatcaggctcctggtgaagatagtgaagtcattctatacccacaagctatctttagagatccattcaggaggggcaacaatatccttgttatgtgtgatgcctatact

SEQ ID NO: 393 - DNA, 200 bp, Amaranthus rudis
agtataggcatcacacataacaaggatattgttgcccctcctgaatggatctctaaagatagcttgtgggtatagaatgacttcactatcttcaccaggagcctgattagtgctagatccatcataattccattttggaagctttttaggatcactcacaggttcatcaagtgttcttgctttacttctcatgtccatac

SEQ ID NO: 394 - DNA, 200 bp, Amaranthus rudis
ccttgttatgtgtgatgcctatactccacaaggagagccaatcccaaccaacaagagacataatgctgaaaagatattcagccatccagatgttgttgccgaggaaccatggtacggtatcgaacaggagtacaccttgctgcaaaaggatgttaactggccccttggtggcctgtagggggtttccctggtccacaggg

SEQ ID NO: 395 - DNA, 200 bp, Amaranthus rudis
ccctgtggaccagggaaaccccctacaggccaccaaggggccagttaacatccttttgcagcaaggtgtactcctgttcgataccgtaccatggttcctcggcaacaacatctggatggctgaatatcttttcagcattatgtctcttgttggttgggattggctctccttgtggagtataggcatcacacataacaagg

SEQ ID NO: 396 - DNA, 200 bp, Amaranthus rudis
tagggggtttccctggtccacagggcccgtactactgtggtgttggtgctgataaagcttttggaagggacattgttgattcacactacaaggcttgcctctatgcaggaatcaacattagtggaatcaatggagaagttatgcccggacagtgggaatttcaagtcggcccgtctgttggaatctctgctggagacgag

SEQ ID NO: 397 - DNA, 200 bp, Amaranthus rudis
ctcgtctccagcagagattccaacagacgggccgacttgaaattcccactgtccgggcataacttctccattgattccactaatgttgattcctgcatagaggcaagccttgtagtgtgaatcaacaatgtcccttccaaaagctttatcagcaccaacaccacagtagtacgggccctgtggaccagggaaacccccta

SEQ ID NO: 398 - DNA, 200 bp, Amaranthus rudis
tgttggaatctctgctggagacgagttgtgggttgctcgttacattttggagaggattaccgagattgctggagtagctctttcttttgatccgaaaccaattccaggtgactggaatggtgctggtgctcacaccaattacagcaccaagtcgatgagggaagatgggggctacgaggtgattaagaaggccatcgaga

SEQ ID NO: 399 - DNA, 200 bp, Amaranthus rudis
tctcgatggccttcttaatcacctcgtagcccccatcttccctcatcgacttggtgctgtaattggtgtgagcaccagcaccattccagtcacctggaattggtttcggatcaaaagaaagagctactccagcaatctcggtaatcctctccaaaatgtaacgagcaacccacaactcgtctccagcagagattccaaca

SEQ ID NO: 400 - DNA, 200 bp, Amaranthus rudis
gaggtgattaagaaggccatcgagaagctcgggttgaggcacaaagagcacatctctgcttatggagaaggaaacgaacgtcgtctcactggtagacacgaaaccgccagcatttccactttcttgtggggggtagccaaccgaggagcatcagttcgtgttggacgagacacggagaagaatggcaaaggatattttga

SEQ ID NO: 401 - DNA, 200 bp, Amaranthus rudis
tcaaaatatcctttgccattcttctccgtgtctcgtccaacacgaactgatgctcctcggttggctaccccccacaagaaagtggaaatgctggcggtttcgtgtctaccagtgagacgacgttcgtttccttctccataagcagagatgtgctctttgtgcctcaacccgagcttctcgatggccttcttaatcacctc

SEQ ID NO: 402 - DNA, 200 bp, Amaranthus rudis
agaagaatggcaaaggatattttgaagacaggaggccggcttctaacatggacccatatgtcgttacatcaatgatcgcagaaactactcttctttggaagccatagagcggccacgagcttaatcaagtaatttgctattaaccagcagatcgattcgcctcttgtgttctgcatctgcctattcaagttgttcgcctt

SEQ ID NO: 403 - DNA, 200 bp, Amaranthus rudis
aaggcgaacaacttgaataggcagatgcagaacacaagaggcgaatcgatctgctggttaatagcaaattacttgattaagctcgtggccgctctatggcttccaaagaagagtagtttctgcgatcattgatgtaacgacatatgggtccatgttagaagccggcctcctgtcttcaaaatatcctttgccattcttct

SEQ ID NO: 404 - DNA, 200 bp, Amaranthus rudis
tctgcctattcaagttgttcgcctttttgttcattttttacacttccattcagaccgattatcatgtacaaaccgtcgcttgctgtttgctgtgcgcgggtaataacatcaaatcctttgtcgcttcgacaatattgaaaataacattgtacccttcttatttcttcctagaaaatatggaaagtcggagaggatcattt

SEQ ID NO: 405 - DNA, 200 bp, Amaranthus rudis
aaatgatcctctccgactttccatattttctaggaagaaataagaagggtacaatgttattttcaatattgtcgaagcgacaaaggatttgatgttattacccgcgcacagcaaacagcaagcgacggtttgtacatgataatcggtctgaatggaagtgtaaaaaatgaacaaaaaggcgaacaacttgaataggcaga

SEQ ID NO: 406 - DNA, 200 bp, Amaranthus rudis
gggacaatcatactcctataacaactttaatcatacactctctcttctttatctctctatattcttcactctctctctagttagttgacgccgccgaccaccttttccgaacccagtgaccaattatggcacagatacttgcaccttacatgcaatgtcagatgaagttttccaaaggctcgactagttcaatgacatta

SEQ ID NO: 407 - DNA, 200 bp, Amaranthus rudis
taatgtcattgaactagtcgagcctttggaaaacttcatctgacattgcatgtaaggtgcaagtatctgtgccataattggtcactgggttcggaaaaggtggtcggcggcgtcaactaactagagagagagtgaagaatatagagagataaagaagagagagtgtatgattaaagttgttataggagtatgattgtccc

SEQ ID NO: 408 - DNA, 200 bp, Amaranthus rudis
aggctcgactagttcaatgacattaagtccttggacttccatatttctgaaagaaaaccaaaagaaatcgattaaatgttctagtaagttcagagtatgtgcttctctcaagtctgaaaacggcactgtaaacagggtggagcagctactcaacttggatgtcactccatacactgacaagataattgcggagtacattt

SEQ ID NO: 409 - DNA, 200 bp, Amaranthus rudis
aaatgtactccgcaattatcttgtcagtgtatggagtgacatccaagttgagtagctgctccaccctgtttacagtgccgttttcagacttgagagaagcacatactctgaacttactagaacatttaatcgatttcttttggttttctttcagaaatatggaagtccaaggacttaatgtcattgaactagtcgagcct

SEQ ID NO: 410 - DNA, 200 bp, Amaranthus rudis
gacaagataattgcggagtacatttggattggaggatctggtattgatgtccgtagcaaatcaaggacaatctctaaacctgttgagcacccatctgagcttcccaagtggaattatgatggctcaagcactggacaagcgccaggagaggacagtgaagtaatcttataccctcaagcaattttcaaggatccattccg

SEQ ID NO: 411 - DNA, 200 bp, Amaranthus rudis
cggaatggatccttgaaaattgcttgagggtataagattacttcactgtcctctcctggcgcttgtccagtgcttgagccatcataattccacttgggaagctcagatgggtgctcaacaggtttagagattgtccttgatttgctacggacatcaataccagatcctccaatccaaatgtactccgcaattatcttgtc

SEQ ID NO: 412 - DNA, 200 bp, Amaranthus rudis
aagcaattttcaaggatccattccgtggtggtaataatatccttgtaatctgtgacacatacaccccagcaggcgaacctattcccactaataaaagatacagggctgcacagatattcagcgacccaaaggttgtatctgaggttccatggtttggaatagagcaggaatacactttgctccaacaaaatgttaaatgg

SEQ ID NO: 413 - DNA, 200 bp, Amaranthus rudis
ccatttaacattttgttggagcaaagtgtattcctgctctattccaaaccatggaacctcagatacaacctttgggtcgctgaatatctgtgcagccctgtatcttttattagtgggaataggttcgcctgctggggtgtatgtgtcacagattacaaggatattattaccaccacggaatggatccttgaaaattgctt

SEQ ID NO: 414 - DNA, 200 bp, Amaranthus rudis
tttgctccaacaaaatgttaaatggcctttggggtggccagtgggagcttatcctggtcctcagggtccatactactgtggtgctggtgctgacaagtcttttggacgtgacatatctgatgctcattacaaagcttgcttgtatgctggcatcaacattagtggcacaaatggggaagttatgcctggccagtgggaat

SEQ ID NO: 415 - DNA, 200 bp, Amaranthus rudis
attcccactggccaggcataacttccccatttgtgccactaatgttgatgccagcatacaagcaagctttgtaatgagcatcagatatgtcacgtccaaaagacttgtcagcaccagcaccacagtagtatggaccctgaggaccaggataagctcccactggccaccccaaaggccatttaacattttgttggagcaaa

SEQ ID NO: 416 - DNA, 200 bp, Amaranthus rudis
gaagttatgcctggccagtgggaattccaagttggcccaagtgttggtattgaagctggagatcatatctggtgtgcgagatatattcttgagagaattactgaacaagctggtgtggttctaactcttgatccaaagcctattgagggtgattggaacggtgcaggttgccatacaaattacagtacaaagaccatgag

SEQ ID NO: 417 - DNA, 200 bp, Amaranthus rudis
ctcatggtctttgtactgtaatttgtatggcaacctgcaccgttccaatcaccctcaataggctttggatcaagagttagaaccacaccagcttgttcagtaattctctcaagaatatatctcgcacaccagatatgatctccagcttcaataccaacacttgggccaacttggaattcccactggccaggcataacttc

SEQ ID NO: 418 - DNA, 200 bp, Amaranthus rudis
caaattacagtacaaagaccatgagagaagatggtggttatgaagcaattaagaaggcaattttgaatctatcattacgccacaaggaccatatcagtgcatatggagaaggaaatgaacgaagattgacagggaagcacgagaccgccagcatcgacacttctcttggggtgttgccaatcgtggttgctctatccgtg

SEQ ID NO: 419 - DNA, 200 bp, Amaranthus rudis
cacggatagagcaaccacgattggcaacaccccaagagaagtgtcgatgctggcggtctcgtgcttccctgtcaatcttcgttcatttccttctccatatgcactgatatggtccttgtggcgtaatgatagattcaaaattgccttcttaattgcttcataaccaccatcttctctcatggtctttgtactgtaatttg

SEQ ID NO: 420 - DNA, 200 bp, Amaranthus rudis
gccaatcgtggttgctctatccgtgtgggtcgtgacacggaaaaggcaggcaaaggttatctggaagataggcggcctgcctcaaacatggacccatacgtggtaacaggtttgctcgcagaaactacaatactttgggaaccaacacttgaggctgaggcactagcagcccaaaaactcgctcttaatgtgtaattcaa

SEQ ID NO: 421 - DNA, 200 bp, Amaranthus rudis
ttgaattacacattaagagcgagtttttgggctgctagtgcctcagcctcaagtgttggttcccaaagtattgtagtttctgcgagcaaacctgttaccacgtatgggtccatgtttgaggcaggccgcctatcttccagataacctttgcctgccttttccgtgtcacgacccacacggatagagcaaccacgattggc

SEQ ID NO: 422 - DNA, 200 bp, Amaranthus rudis
aactcgctcttaatgtgtaattcaatcataatcgtgccagaatatcgcatattcatgaacgagggaactctttcacgtgcccagaatttgcttatttttagtttttagtatcctgggtatgtgagtgttttcattcatgacctttgcttctgatcattgtttgttttgggagttcaagagaagaataatttgtaactgtt

SEQ ID NO: 423 - DNA, 200 bp, Amaranthus rudis
aacagttacaaattattcttctcttgaactcccaaaacaaacaatgatcagaagcaaaggtcatgaatgaaaacactcacatacccaggatactaaaaactaaaaataagcaaattctgggcacgtgaaagagttccctcgttcatgaatatgcgatattctggcacgattatgattgaattacacattaagagcgagtt

SEQ ID NO: 424 - DNA, 200 bp, Amaranthus rudis
tgcagggggtagccaaccgaggagcatcggttcgtgttggacgagacacggagaagaatggcaaaggatattttgaagacaggaggccggcttctaacatggacccatatgtcgttacatcaatgatcgcagaaactactcttctttggaagccatagagcggccacgagcttaatcaagtaatttgctattaaccagca

SEQ ID NO: 425 - DNA, 200 bp, Amaranthus rudis
tgctggttaatagcaaattacttgattaagctcgtggccgctctatggcttccaaagaagagtagtttctgcgatcattgatgtaacgacatatgggtccatgttagaagccggcctcctgtcttcaaaatatcctttgccattcttctccgtgtctcgtccaacacgaaccgatgctcctcggttggctaccccctgca

SEQ ID NO: 426 - DNA, 200 bp, Amaranthus rudis
tgtaataccctaacatattttttttgtcgttgggagaagtgaccaattatggcacagatacttgcaccttacatgcaatgtcagatgaagttctcaaaaggctcaacaagttcaatgacatcaaatccttggacttcaatatttcttaaagaaaataaaaagggatcaattaaatgctctagtaagttcagagtatgtgc

SEQ ID NO: 427 - DNA, 200 bp, Amaranthus rudis
gcacatactctgaacttactagagcatttaattgatccctttttattttctttaagaaatattgaagtccaaggatttgatgtcattgaacttgttgagccttttgagaacttcatctgacattgcatgtaaggtgcaagtatctgtgccataattggtcacttctcccaacgacaaaaaaaatatgttagggtattaca

SEQ ID NO: 428 - DNA, 200 bp, Amaranthus rudis
gctctagtaagttcagagtatgtgcttctctccaatctgaaaatagcacaataaacagggtggagcagctactcaacttggatgtcactccatacactgacaagataattgcagagtacatttggtatatgttttttctttgttatatgatcaaaagtgttgatgactttaggccagatgtcacattaattatttcaagc

SEQ ID NO: 429 - DNA, 200 bp, Amaranthus rudis
gcttgaaataattaatgtgacatctggcctaaagtcatcaacacttttgatcatataacaaagaaaaaacatataccaaatgtactctgcaattatcttgtcagtgtatggagtgacatccaagttgagtagctgctccaccctgtttattgtgctattttcagattggagagaagcacatactctgaacttactagagc

SEQ ID NO: 430 - DNA, 200 bp, Amaranthus rudis
agatgtcacattaattatttcaagctaatggttgtaccaatatgagtttctgctcatctgtagataaggcattcttggtgtttcctactttcaatctgattatagaactaattgatctacgattgtgctttggaacaggattggaggatctggtattgacgtccgtagcaaatcaagggtacaataacactgatgctgtt

SEQ ID NO: 431 - DNA, 200 bp, Amaranthus rudis
aacagcatcagtgttattgtacccttgatttgctacggacgtcaataccagatcctccaatcctgttccaaagcacaatcgtagatcaattagttctataatcagattgaaagtaggaaacaccaagaatgccttatctacagatgagcagaaactcatattggtacaaccattagcttgaaataattaatgtgacatct

SEQ ID NO: 432 - DNA, 200 bp, Amaranthus rudis
agggtacaataacactgatgctgttgattgattgttaaaccagcatttagatgctgagcatacttcattttttctctgaccaatgtttcttaatataccagactatctctaaacctgttgagcacccatctgagcttcccaagtggaattatgatgggtcaagcactggacaagcgccaggagaggatagtgaagtaatc

SEQ ID NO: 433 - DNA, 200 bp, Amaranthus rudis
gattacttcactatcctctcctggcgcttgtccagtgcttgacccatcataattccacttgggaagctcagatgggtgctcaacaggtttagagatagtctggtatattaagaaacattggtcagagaaaaaatgaagtatgctcagcatctaaatgctggtttaacaatcaatcaacagcatcagtgttattgtaccct

SEQ ID NO: 434 - DNA, 200 bp, Amaranthus rudis
gccaggagaggatagtgaagtaatcttatagtaagattttggggaagctacaaaccttattacatttgcttgataattattgtccttgtttttgagtgattatcttttgaggcttgagagttattgtgactgatcattaattcattattgtgtgtcatattttcatatacagccctcaagcaattttcaaggatccattc

SEQ ID NO: 435 - DNA, 200 bp, Amaranthus rudis
gaatggatccttgaaaattgcttgagggctgtatatgaaaatatgacacacaataatgaattaatgatcagtcacaataactctcaagcctcaaaagataatcactcaaaaacaaggacaataattatcaagcaaatgtaataaggtttgtagcttccccaaaatcttactataagattacttcactatcctctcctggc

SEQ ID NO: 436 - DNA, 200 bp, Amaranthus rudis
tcaagcaattttcaaggatccattccgtggtggtaataatatccttgtgagtcatagtctctgacttagtcatgaatcagaatatttattccaacgcttttgatgttacctcaattgttgagaatatcaatataattttgctatgcaatgtaaacttaggtaatctgtgacacatacaccccagcaggcgaacctattcc

SEQ ID NO: 437 - DNA, 200 bp, Amaranthus rudis
ggaataggttcgcctgctggggtgtatgtgtcacagattacctaagtttacattgcatagcaaaattatattgatattctcaacaattgaggtaacatcaaaagcgttggaataaatattctgattcatgactaagtcagagactatgactcacaaggatattattaccaccacggaatggatccttgaaaattgcttga

SEQ ID NO: 438 - DNA, 200 bp, Amaranthus rudis
acaccccagcaggcgaacctattcccactaataaaagatacagggctgcacagatattcagcgacccaaaggttgtatctgaggttccatggtaagaaattcccatcattgacaatattttggtcttaattgcatttcatagttaacactttgcactgcaaggatgaattttatagaaagttgacacactatgagaaatg

SEQ ID NO: 439 - DNA, 200 bp, Amaranthus rudis
catttctcatagtgtgtcaactttctataaaattcatccttgcagtgcaaagtgttaactatgaaatgcaattaagaccaaaatattgtcaatgatgggaatttcttaccatggaacctcagatacaacctttgggtcgctgaatatctgtgcagccctgtatcttttattagtgggaataggttcgcctgctggggtgt

SEQ ID NO: 440 - DNA, 200 bp, Amaranthus rudis
gaaagttgacacactatgagaaatgacaaatgaaaaattgatttctctcgtctttttttaaaagacaatgcatagacaaatgaaaaattgatttctctcgtcttcttctaaaagacaatgcatagattatgtgatgggtaccactaagggaataacttaaccaaagttcacataaatttgaagggtaaattgtgggatgt

SEQ ID NO: 441 - DNA, 200 bp, Amaranthus rudis
acatcccacaatttacccttcaaatttatgtgaactttggttaagttattcccttagtggtacccatcacataatctatgcattgtcttttagaagaagacgagagaaatcaatttttcatttgtctatgcattgtcttttaaaaaaagacgagagaaatcaatttttcatttgtcatttctcatagtgtgtcaactttc

SEQ ID NO: 442 - DNA, 200 bp, Amaranthus rudis
atttgaagggtaaattgtgggatgtacaatctaatctctcaatggttcttctggtgtctagggttaaaactaatctttttgagtaagataagattgaactctccgaattcattaaaaattttcaagaactcgtcaatgttacaactcaaggttggacaaaatcaacacaatcattcgtgtaaacacagcgaatttgctta

SEQ ID NO: 443 - DNA, 200 bp, Amaranthus rudis
taagcaaattcgctgtgtttacacgaatgattgtgttgattttgtccaaccttgagttgtaacattgacgagttcttgaaaatttttaatgaattcggagagttcaatcttatcttactcaaaaagattagttttaaccctagacaccagaagaaccattgagagattagattgtacatcccacaatttacccttcaaat

SEQ ID NO: 444 - DNA, 200 bp, Amaranthus rudis
cgtgtaaacacagcgaatttgcttaaggtgttcaactttgtattctctaaataatgcatacaatctagggccctcggctacttcgacgagaacatacctctagtatgactcttattaggattttcctgaatattgctaaatcaaatgtcttttgatttaaaagtaatcctacccttatctggagtgtaaaaatatccggc

SEQ ID NO: 445 - DNA, 200 bp, Amaranthus rudis
gccggatatttttacactccagataagggtaggattacttttaaatcaaaagacatttgatttagcaatattcaggaaaatcctaataagagtcatactagaggtatgttctcgtcgaagtagccgagggccctagattgtatgcattatttagagaatacaaagttgaacaccttaagcaaattcgctgtgtttacacg

SEQ ID NO: 446 - DNA, 200 bp, Amaranthus rudis
tatctggagtgtaaaaatatccggcaatccaacaagaaaaccacaacctaaacctacttctactaggatatggtcaaacgatgaagaagcttccaaggacatttgacatggatagaactttgagtattaactcatgcaatccaagatcaatttgcaaacaagtgaataaaggatccaagttgggacttaggagaggacaa

SEQ ID NO: 447 - DNA, 200 bp, Amaranthus rudis
ttgtcctctcctaagtcccaacttggatcctttattcacttgtttgcaaattgatcttggattgcatgagttaatactcaaagttctatccatgtcaaatgtccttggaagcttcttcatcgtttgaccatatcctagtagaagtaggtttaggttgtggttttcttgttggattgccggatatttttacactccagata

SEQ ID NO: 448 - DNA, 200 bp, Amaranthus spinosus
ccattattccacactccacactacccatttcattctgctcactctccatccttctttctcgctcctttatctctctatattcatctctctctctagcttgttcacgacgccgaccacccttttccgatcccaggtaaaagtgaccaaacatggcacaaatacttgcaccttacatgcaatgtcagatgaagttttcaaaa

SEQ ID NO: 449 - DNA, 200 bp, Amaranthus spinosus
ttttgaaaacttcatctgacattgcatgtaaggtgcaagtatttgtgccatgtttggtcacttttacctgggatcggaaaagggtggtcggcgtcgtgaacaagctagagagagagatgaatatagagagataaaggagcgagaaagaaggatggagagtgagcagaatgaaatgggtagtgtggagtgtggaataatgg

SEQ ID NO: 450 - DNA, 200 bp, Amaranthus spinosus
gcaatgtcagatgaagttttcaaaaggctccacaagttcaatgacatcaaatccttggacttcaatatttcttaaagaaaataaaaagggatcaattaaatgctctagtaagttcagagtatgtgcttctctccaatctgataatagcacagtaaacagggtggagcagctactcaacttggatgtcactccatacactg

SEQ ID NO: 451 - DNA, 200 bp, Amaranthus spinosus
cagtgtatggagtgacatccaagttgagtagctgctccaccctgtttactgtgctattatcagattggagagaagcacatactctgaacttactagagcatttaattgatccctttttattttctttaagaaatattgaagtccaaggatttgatgtcattgaacttgtggagccttttgaaaacttcatctgacattgc

SEQ ID NO: 452 - DNA, 200 bp, Amaranthus spinosus
aacttggatgtcactccatacactgacaagataattgcagagtacatttggattggaggatctggcattgatgttcgtagcaaatcaaggacaatctctaaacctgttgagcacccatctgagcttcccaagtggaattatgatggctcaagcactggacaagcgccaggagaggacagtgaagtaatcttataccctca

SEQ ID NO: 453 - DNA, 200 bp, Amaranthus spinosus
tgagggtataagattacttcactgtcctctcctggcgcttgtccagtgcttgagccatcataattccacttgggaagctcagatgggtgctcaacaggtttagagattgtccttgatttgctacgaacatcaatgccagatcctccaatccaaatgtactctgcaattatcttgtcagtgtatggagtgacatccaagtt

SEQ ID NO: 454 - DNA, 200 bp, Amaranthus spinosus
acagtgaagtaatcttataccctcaagcaattttcaaggatccattccgtggtggtaataatatccttgtaatctgtgacacatacacaccagcaggcgaacccatccccactaataaaagatacagggctgcacagatatttagcgacccaaaggttgtttctgagattccatggtttggaatagagcaggaatacacg

SEQ ID NO: 455 - DNA, 200 bp, Amaranthus spinosus
cgtgtattcctgctctattccaaaccatggaatctcagaaacaacctttgggtcgctaaatatctgtgcagccctgtatcttttattagtggggatgggttcgcctgctggtgtgtatgtgtcacagattacaaggatattattaccaccacggaatggatccttgaaaattgcttgagggtataagattacttcactgt

SEQ ID NO: 456 - DNA, 200 bp, Amaranthus spinosus
gtttggaatagagcaggaatacacgttgctccaacaaaatgttaaatggcctttgggatggcctgtgggagcctatcctggtcctcagggtccatactattgtggtgctggtgctgacaaatcttttggacgtgacatatctgatgctcattacaaagcttgcttgtatgctggcatcaacattagtggcacaaatgggg

SEQ ID NO: 457 - DNA, 200 bp, Amaranthus spinosus
ccccatttgtgccactaatgttgatgccagcatacaagcaagctttgtaatgagcatcagatatgtcacgtccaaaagatttgtcagcaccagcaccacaatagtatggaccctgaggaccaggataggctcccacaggccatcccaaaggccatttaacattttgttggagcaacgtgtattcctgctctattccaaac

SEQ ID NO: 458 - DNA, 200 bp, Amaranthus spinosus
atcaacattagtggcacaaatggggaagttatgcctggccagtgggaattccaagttggcccaagtgttggtattgaagctggagatcatatctggtgtgcgagatatattcttgagagaattactgaacaagctggtgtggttctgactcttgatccaaagcctattgagggtgattggaacggtgcaggttgccatac

SEQ ID NO: 459 - DNA, 200 bp, Amaranthus spinosus
gtatggcaacctgcaccgttccaatcaccctcaataggctttggatcaagagtcagaaccacaccagcttgttcagtaattctctcaagaatatatctcgcacaccagatatgatctccagcttcaataccaacacttgggccaacttggaattcccactggccaggcataacttccccatttgtgccactaatgttgat

SEQ ID NO: 460 - DNA, 200 bp, Amaranthus spinosus
attggaacggtgcaggttgccataccaattacagtacaaagaccatgagagaagatggtggttatgaagcaattaagaaggcaattttgaatctttcattacgccacaaggaccatatcagtgcatatggagaaggaaatgaacgaaggctgacagggaagcacgagaccgccagcatcgacacattctcttggggtgtt

SEQ ID NO: 461 - DNA, 200 bp, Amaranthus spinosus
aacaccccaagagaatgtgtcgatgctggcggtctcgtgcttccctgtcagccttcgttcatttccttctccatatgcactgatatggtccttgtggcgtaatgaaagattcaaaattgccttcttaattgcttcataaccaccatcttctctcatggtctttgtactgtaattggtatggcaacctgcaccgttccaat

SEQ ID NO: 462 - DNA, 200 bp, Amaranthus spinosus
catcgacacattctcttggggtgttgccaatcgtggttgctctatccgtgtgggtcgtgacacggaaaaggcaggaaaaggttatctggaagatagacggcctgcctcaaacatggacccatacgtggtaacaggtttgctcgcagaaactacaatactttgggaaccaacacttgaggctgaggcactcgcagcccaaa

SEQ ID NO: 463 - DNA, 200 bp, Amaranthus spinosus
tttgggctgcgagtgcctcagcctcaagtgttggttcccaaagtattgtagtttctgcgagcaaacctgttaccacgtatgggtccatgtttgaggcaggccgtctatcttccagataaccttttcctgccttttccgtgtcacgacccacacggatagagcaaccacgattggcaacaccccaagagaatgtgtcgatg

SEQ ID NO: 464 - DNA, 200 bp, Amaranthus spinosus
gaggctgaggcactcgcagcccaaaaactcgctcttaatgtctaattcaatcataattcgtgccagaatatcgcatattcttgaacgagggaactctttcacgtgcccagaattcgctttttttagttttagtatcctgggtatgtgagtgttttcattcgtgacctttgcttctgatcattgtttgttttgggtgttca

SEQ ID NO: 465 - DNA, 200 bp, Amaranthus spinosus
tgaacacccaaaacaaacaatgatcagaagcaaaggtcacgaatgaaaacactcacatacccaggatactaaaactaaaaaaagcgaattctgggcacgtgaaagagttccctcgttcaagaatatgcgatattctggcacgaattatgattgaattagacattaagagcgagtttttgggctgcgagtgcctcagcctc

SEQ ID NO: 466 - DNA, 200 bp, Amaranthus thunbergii
cattattccacactccacactacccatttcattctgcttactctccatccttctttctcactcctttatctctctctctctctagctcacccttttccgaacccaggtaaaagtgatcaaacatggcacaaatacttgcaccttacatgcaatgtcagatgaagttctcaaaaggctcaacaagttcaatgacatcaaat

SEQ ID NO: 467 - DNA, 200 bp, Amaranthus thunbergii
atttgatgtcattgaacttgttgagccttttgagaacttcatctgacattgcatgtaaggtgcaagtatttgtgccatgtttgatcacttttacctgggttcggaaaagggtgagctagagagagagagagataaaggagtgagaaagaaggatggagagtaagcagaatgaaatgggtagtgtggagtgtggaataatg

SEQ ID NO: 468 - DNA, 200 bp, Amaranthus thunbergii
ctcaacaagttcaatgacatcaaatccttggacttcaatatttcttaaagaaaataaaaagggatcaattaaatgctctagtaagttcagagtatgtgcttctctccaatctgaaaatagcacaataaacagggtggagcagctactcaacttagatgtcactccatacactgacaagataattgcagagtacatttgga

SEQ ID NO: 469 - DNA, 200 bp, Amaranthus thunbergii
tccaaatgtactctgcaattatcttgtcagtgtatggagtgacatctaagttgagtagctgctccaccctgtttattgtgctattttcagattggagagaagcacatactctgaacttactagagcatttaattgatccctttttattttctttaagaaatattgaagtccaaggatttgatgtcattgaacttgttgag

SEQ ID NO: 470 - DNA, 200 bp, Amaranthus thunbergii
aagataattgcagagtacatttggattggaggatctggtattgatgttcgtagcaaatcaaggacaatctctaaacctgttgagcacccatctgagcttcccaagtggaattatgatggctcaagcactggacaagcgccaggagaggacagtgaagtaatcttataccctcaagcaattttcaaggatccgttccgtgg

SEQ ID NO: 471 - DNA, 200 bp, Amaranthus thunbergii
ccacggaacggatccttgaaaattgcttgagggtataagattacttcactgtcctctcctggcgcttgtccagtgcttgagccatcataattccacttgggaagctcagatgggtgctcaacaggtttagagattgtccttgatttgctacgaacatcaataccagatcctccaatccaaatgtactctgcaattatctt

SEQ ID NO: 472 - DNA, 200 bp, Amaranthus thunbergii
caattttcaaggatccgttccgtggtggtaataatatccttgtaatctgtgacacatacacaccagcaggcgaacccatccccactaataaaagatacagggctgcacagatctttagcgacccaaaggttgtttctgagattccatggtttggaatagagcaggaatacacgttgctccaacaaaatgttaaatggcct

SEQ ID NO: 473 - DNA, 200 bp, Amaranthus thunbergii
aggccatttaacattttgttggagcaacgtgtattcctgctctattccaaaccatggaatctcagaaacaacctttgggtcgctaaagatctgtgcagccctgtatcttttattagtggggatgggttcgcctgctggtgtgtatgtgtcacagattacaaggatattattaccaccacggaacggatccttgaaaattg

SEQ ID NO: 474 - DNA, 200 bp, Amaranthus thunbergii
gctccaacaaaatgttaaatggcctttgggatggcctgttggagcctatcctggtcctcagggtccatactattgtggtgctggtgctgacaaatcttttggacgtgacatatctgatgctcattacaaagcttgcttgtatgctggcatcaacattagtggcacaaatggggaagttatgcctggccagtgggaattcc

SEQ ID NO: 475 - DNA, 200 bp, Amaranthus thunbergii
ggaattcccactggccaggcataacttccccatttgtgccactaatgttgatgccagcatacaagcaagctttgtaatgagcatcagatatgtcacgtccaaaagatttgtcagcaccagcaccacaatagtatggaccctgaggaccaggataggctccaacaggccatcccaaaggccatttaacattttgttggagc

SEQ ID NO: 476 - DNA, 200 bp, Amaranthus thunbergii
gttatgcctggccagtgggaattccaagttggcccaagtgttggtattgaagctggagatcatatctggtgtgcaagatatattcttgagagaattactgaacaagctggtgtggttctgactcttgatccaaagcctattgagggtgattggaacggtgcaggttgccataccaattacagtacaaagaccatgagaga

SEQ ID NO: 477 - DNA, 200 bp, Amaranthus thunbergii
tctctcatggtctttgtactgtaattggtatggcaacctgcaccgttccaatcaccctcaataggctttggatcaagagtcagaaccacaccagcttgttcagtaattctctcaagaatatatcttgcacaccagatatgatctccagcttcaataccaacacttgggccaacttggaattcccactggccaggcataac

SEQ ID NO: 478 - DNA, 200 bp, Amaranthus thunbergii
attacagtacaaagaccatgagagaagatggtggttatgaagcaattaagaaggcaattttgaatctatcattacgccacaaggaccatatcagtgcatatggagaaggaaatgaacgaagattgacagggaagcacgagaccgccagcatcgacactttctcttggggtgttgccaatcgtggttgctctatccgtgtg

SEQ ID NO: 479 - DNA, 200 bp, Amaranthus thunbergii
cacacggatagagcaaccacgattggcaacaccccaagagaaagtgtcgatgctggcggtctcgtgcttccctgtcaatcttcgttcatttccttctccatatgcactgatatggtccttgtggcgtaatgatagattcaaaattgccttcttaattgcttcataaccaccatcttctctcatggtctttgtactgtaat

SEQ ID NO: 480 - DNA, 200 bp, Amaranthus thunbergii
caatcgtggttgctctatccgtgtgggccgtgacacagaaaaagcaggcaaaggttatctggaagacaggcggcctgcctcaaacatggacccatacgtggtaacaggtttgcttgcagaaactacaatactttgggaaccaacacttgaggctgaggcactagcagcccaaaaactcgctcttaatgtgtaattcaatc

SEQ ID NO: 481 - DNA, 200 bp, Amaranthus thunbergii
gattgaattacacattaagagcgagtttttgggctgctagtgcctcagcctcaagtgttggttcccaaagtattgtagtttctgcaagcaaacctgttaccacgtatgggtccatgtttgaggcaggccgcctgtcttccagataacctttgcctgctttttctgtgtcacggcccacacggatagagcaaccacgattg

SEQ ID NO: 482 - DNA, 200 bp, Amaranthus thunbergii
ctcgctcttaatgtgtaattcaatcataatcgtgccagaatatcgcatattcatgaacgagggaactctttcacgtgcccagaatttgcttatttttagtttttagtatcctgggtatgtgagtgttttcattcatgacctttgcttctgatcattgtttgttttgggagttcaagagaagaataatttgtaactgttgc

SEQ ID NO: 483 - DNA, 200 bp, Amaranthus thunbergii
gcaacagttacaaattattcttctcttgaactcccaaaacaaacaatgatcagaagcaaaggtcatgaatgaaaacactcacatacccaggatactaaaaactaaaaataagcaaattctgggcacgtgaaagagttccctcgttcatgaatatgcgatattctggcacgattatgattgaattacacattaagagcgag

SEQ ID NO: 484 - DNA, 200 bp, Amaranthus viridis
ccattattccattctacccatacttgggacaatcatactcctctaactcctttaaccatactcattacacactctctcttctttatctctctatattcttcactctctctctagttacttgacgccgccgaccaccttttccgaacccagtgaccaattatggcacagatacttgcacctaacatgcaatgtcagatgaa

SEQ ID NO: 485 - DNA, 200 bp, Amaranthus viridis
ttcatctgacattgcatgttaggtgcaagtatctgtgccataattggtcactgggttcggaaaaggtggtcggcggcgtcaagtaactagagagagagtgaagaatatagagagataaagaagagagagtgtgtaatgagtatggttaaaggagttagaggagtatgattgtcccaagtatgggtagaatggaataatgg

SEQ ID NO: 486 - DNA, 200 bp, Amaranthus viridis
cacctaacatgcaatgtcagatgaagttttccaaaggctcgacaagttcaatgacattaagtccttggacttccatatttctgaaagaaaaccaaaagaaatcgattaaatgctctagtaagttcagagtgtgtgcttctctcaaatctgaaaacagcactgtaaacagggtggagcagctactcaacttggatgtcact

SEQ ID NO: 487 - DNA, 200 bp, Amaranthus viridis
agtgacatccaagttgagtagctgctccaccctgtttacagtgctgttttcagatttgagagaagcacacactctgaacttactagagcatttaatcgatttcttttggttttctttcagaaatatggaagtccaaggacttaatgtcattgaacttgtcgagcctttggaaaacttcatctgacattgcatgttaggtg

SEQ ID NO: 488 - DNA, 200 bp, Amaranthus viridis
gcagctactcaacttggatgtcactccatacactgacaagataattgcagagtacatttggattggaggatccggtattgatgtccgtagcaaatcaaggacaatctctaaacctgttgagcacccatctgagcttcccaagtggaattatgatggctcaagtacaggacaagctcccggagaggacagtgaagtaatct

SEQ ID NO: 489 - DNA, 200 bp, Amaranthus viridis
agattacttcactgtcctctccgggagcttgtcctgtacttgagccatcataattccacttgggaagctcagatgggtgctcaacaggtttagagattgtccttgatttgctacggacatcaataccggatcctccaatccaaatgtactctgcaattatcttgtcagtgtatggagtgacatccaagttgagtagctgc

SEQ ID NO: 490 - DNA, 200 bp, Amaranthus viridis
cccggagaggacagtgaagtaatcttataccctcaagcaattttcaaggatccattccgtggtggtaataatatccttgtaatctgtgacacatacaccccagcaggcgaacctattcccactaacaaaagatacagggctgcacagatattcagcgacccaaaggttgtttccgaggttccatggtttggaatagagca

SEQ ID NO: 491 - DNA, 200 bp, Amaranthus viridis
tgctctattccaaaccatggaacctcggaaacaacctttgggtcgctgaatatctgtgcagccctgtatcttttgttagtgggaataggttcgcctgctggggtgtatgtgtcacagattacaaggatattattaccaccacggaatggatccttgaaaattgcttgagggtataagattacttcactgtcctctccggg

SEQ ID NO: 492 - DNA, 200 bp, Amaranthus viridis
aggttccatggtttggaatagagcaggaatacactttgctccaacaaaatgttaaatggcctttgggatggcccgtgggagcctatcctggtcctcagggtccatactactgtggtgctggtgctgacaaatcttttggacgtgacatatctgatgctcattacaaagcttgtttgtatgccggtattaacattagtggc

SEQ ID NO: 493 - DNA, 200 bp, Amaranthus viridis
gccactaatgttaataccggcatacaaacaagctttgtaatgagcatcagatatgtcacgtccaaaagatttgtcagcaccagcaccacagtagtatggaccctgaggaccaggataggctcccacgggccatcccaaaggccatttaacattttgttggagcaaagtgtattcctgctctattccaaaccatggaacct

SEQ ID NO: 494 - DNA, 200 bp, Amaranthus viridis
gtatgccggtattaacattagtggcacaaatggggaagttatgcctggccagtgggaattccaagttggtccaagtgttggcattgaagctggagatcatatctggtgtgctagatacattctcgagagaattactgaacaagctggtgtggttctgactcttgatccaaagcctattgagggtgattggaatggtgcag

SEQ ID NO: 495 - DNA, 200 bp, Amaranthus viridis
ctgcaccattccaatcaccctcaataggctttggatcaagagtcagaaccacaccagcttgttcagtaattctctcgagaatgtatctagcacaccagatatgatctccagcttcaatgccaacacttggaccaacttggaattcccactggccaggcataacttccccatttgtgccactaatgttaataccggcatac

SEQ ID NO: 496 - DNA, 200 bp, Amaranthus viridis
attgagggtgattggaatggtgcaggttgccatacaaactacagtacaaagaccatgagagaagatggtggttatgaagcaattaagaaggcaattttgaatctatcattacgccacaaggaccatatcagtgcatatggagaaggaaatgaacgaagattgacagggaagcacgagaccgccagcatcgacactttctc

SEQ ID NO: 497 - DNA, 200 bp, Amaranthus viridis
gagaaagtgtcgatgctggcggtctcgtgcttccctgtcaatcttcgttcatttccttctccatatgcactgatatggtccttgtggcgtaatgatagattcaaaattgccttcttaattgcttcataaccaccatcttctctcatggtctttgtactgtagtttgtatggcaacctgcaccattccaatcaccctcaat

SEQ ID NO: 498 - DNA, 200 bp, Amaranthus viridis
agaccgccagcatcgacactttctcttggggtgttgccaatcgtggttgctctatccgtgtgggccgtgacacagaaaaagcaggcaaaggttatctggaagacaggcggcctgcctcaaacatggacccatacgtggtgacaggtttgctcgcagaaactacaatactttgggaaccaacacttgaggctgaggcacta

SEQ ID NO: 499 - DNA, 200 bp, Amaranthus viridis
tagtgcctcagcctcaagtgttggttcccaaagtattgtagtttctgcgagcaaacctgtcaccacgtatgggtccatgtttgaggcaggccgcctgtcttccagataacctttgcctgctttttctgtgtcacggcccacacggatagagcaaccacgattggcaacaccccaagagaaagtgtcgatgctggcggtct

SEQ ID NO: 500 - DNA, 200 bp, Amaranthus viridis
accaacacttgaggctgaggcactagcagcccaaaaactcgctcttaatgtgtaattcaaccataatcgtgccagaatatcgcatattcatgaacgagggaactctttcacgtgcccagaatttgcttattttagttttagtatcctgggtatgtgagtgttttcattcatgacctttgcttctgatcattgtttgtttt

SEQ ID NO: 501 - DNA, 200 bp, Amaranthus viridis
aaaacaaacaatgatcagaagcaaaggtcatgaatgaaaacactcacatacccaggatactaaaactaaaataagcaaattctgggcacgtgaaagagttccctcgttcatgaatatgcgatattctggcacgattatggttgaattacacattaagagcgagtttttgggctgctagtgcctcagcctcaagtgttggt

SEQ ID NO: 502 - DNA, 200 bp, Ambrosia artemisiifolia
tttaacaatttaatacatttttgttgtgaaaagatttgatctttatgttttatttgttgcagggcgttgcaaaccgtggagcatctattcgggtcgggagggacactgagaaagaggggaaagggtactttgaggaccgaaggccggcttctaacatggatccatatgtggtgacctccatgattgctgagaccaccatc

SEQ ID NO: 503 - DNA, 200 bp, Ambrosia artemisiifolia
gatggtggtctcagcaatcatggaggtcaccacatatggatccatgttagaagccggccttcggtcctcaaagtaccctttcccctctttctcagtgtccctcccgacccgaatagatgctccacggtttgcaacgccctgcaacaaataaaacataaagatcaaatcttttcacaacaaaaatgtattaaattgttaaa

SEQ ID NO: 504 - DNA, 200 bp, Ambrosia artemisiifolia
ctccatgattgctgagaccaccatcttgtggaacaaatcttgaagataacaagatttggatgatgacattatgaagcctgatatggagggagattgaaaaaagtaactggaatttggaaacaacccttctatatgtactttgttaaaatttaggtgcatcctactctgtttgcttgtttatttttacttgatgtttcata

SEQ ID NO: 505 - DNA, 200 bp, Ambrosia artemisiifolia
tatgaaacatcaagtaaaaataaacaagcaaacagagtaggatgcacctaaattttaacaaagtacatatagaagggttgtttccaaattccagttacttttttcaatctccctccatatcaggcttcataatgtcatcatccaaatcttgttatcttcaagatttgttccacaagatggtggtctcagcaatcatggag

SEQ ID NO: 506 - DNA, 200 bp, Ambrosia artemisiifolia
gtttatttttacttgatgtttcatatgttctttataatggaaagcattttgagtccaaaatgctaatggtagctacttgatttgatttgagattttcccattgggaatattgtcaatatgtctattttgaataacaatatggaggggttgattcctatttgtgtttgtgtttttgtttgcttgacatgcattcattatac

SEQ ID NO: 507 - DNA, 200 bp, Ambrosia artemisiifolia
gtataatgaatgcatgtcaagcaaacaaaaacacaaacacaaataggaatcaacccctccatattgttattcaaaatagacatattgacaatattcccaatgggaaaatctcaaatcaaatcaagtagctaccattagcattttggactcaaaatgctttccattataaagaacatatgaaacatcaagtaaaaataaac

SEQ ID NO: 508 - DNA, 200 bp, Ambrosia trifida
tattattattaactatgcaatatcctaactttttgttttttacgatataatttatcgctttaacagagaattactgagcaagctggtgttgtcctaacacttgaccctaaaccgattgaggtaatagaaatcaatttcaaccgttttaataaattattattattgtggcgaattggacgtacaaaaagataatatttttt

SEQ ID NO: 509 - DNA, 200 bp, Ambrosia trifida
aaaaaatattatctttttgtacgtccaattcgccacaataataataatttattaaaacggttgaaattgatttctattacctcaatcggtttagggtcaagtgttaggacaacaccagcttgctcagtaattctctgttaaagcgataaattatatcgtaaaaaacaaaaagttaggatattgcatagttaataataata

SEQ ID NO: 510 - DNA, 200 bp, Ambrosia trifida
gacgtacaaaaagataatattttttccattagttatgttagtgagcttatatctaactgcacaaattcttctggtttgcgctgacagggagactggaatggcgcaggatgccacactaactacaggtactcgctttctcatactaatcatcaccgtttcggaataaaaccaaaatattatcatgttttttcaacctttat

SEQ ID NO: 511 - DNA, 200 bp, Ambrosia trifida
ataaaggttgaaaaaacatgataatattttggttttattccgaaacggtgatgattagtatgagaaagcgagtacctgtagttagtgtggcatcctgcgccattccagtctccctgtcagcgcaaaccagaagaatttgtgcagttagatataagctcactaacataactaatggaaaaaatattatctttttgtacgtc

SEQ ID NO: 512 - DNA, 200 bp, Ambrosia trifida
attatcatgttttttcaacctttattacatttaaatttattttctaaacaatttgcagtacaaaggccatgagagaagacggtggatttgaggtgattaaaaaggcgattttgaacctttctcttcgccacaaagaacacatcagtgcttacggtgaaggaaatgagagaagattgactgggaaacacgaaactgccagc

SEQ ID NO: 513 - DNA, 200 bp, Ambrosia trifida
gctggcagtttcgtgtttcccagtcaatcttctctcatttccttcaccgtaagcactgatgtgttctttgtggcgaagagaaaggttcaaaatcgcctttttaatcacctcaaatccaccgtcttctctcatggcctttgtactgcaaattgtttagaaaataaatttaaatgtaataaaggttgaaaaaacatgataat

SEQ ID NO: 514 - DNA, 200 bp, Ambrosia trifida
gactgggaaacacgaaactgccagcatcaaccaattttcatgggtatatatagaacactttctactcaattttataaaaaaaaagtgcgaaggtttcgtaagtttttctcaacttgtatattttgcatttggccaactttcagggagtagctaaccgtggttgctcaatccgtgtgggtcgtgacactgagaaggccggc

SEQ ID NO: 515 - DNA, 200 bp, Ambrosia trifida
gccggccttctcagtgtcacgacccacacggattgagcaaccacggttagctactccctgaaagttggccaaatgcaaaatatacaagttgagaaaaacttacgaaaccttcgcactttttttttataaaattgagtagaaagtgttctatatatacccatgaaaattggttgatgctggcagtttcgtgtttcccagtc

SEQ ID NO: 516 - DNA, 200 bp, Ambrosia trifida
gggtcgtgacactgagaaggccggcaaaggtattgaattttttttatttatttatttttttttttaattcgaacatgcatagtaaacacataacctggttttattgaaataattctcctttgttctgattttttttcatggttaatttggattacgcgtaggttacttggaagacaggcgtccggcatcaaacatggacc

SEQ ID NO: 517 - DNA, 200 bp, Ambrosia trifida
ggtccatgtttgatgccggacgcctgtcttccaagtaacctacgcgtaatccaaattaaccatgaaaaaaaatcagaacaaaggagaattatttcaataaaaccaggttatgtgtttactatgcatgttcgaattaaaaaaaaaaataaataaataaaaaaaattcaatacctttgccggccttctcagtgtcacgaccc

SEQ ID NO: 518 - DNA, 200 bp, Ambrosia trifida
ttaatgtgtaggttacttggaagacaggcgtccggcatcaaacatggacccatatacagtgactggattacttgcagaaaccaccatcctgtgggagcctagtcttgaggccgaagcactggctgcgcagaagctggcattgaatgtgtagactcaagtcaacttatgatcttcgaaagctcggtgttctgtttctagtt

SEQ ID NO: 519 - DNA, 200 bp, Ambrosia trifida
aactagaaacagaacaccgagctttcgaagatcataagttgacttgagtctacacattcaatgccagcttctgcgcagccagtgcttcggcctcaagactaggctcccacaggatggtggtttctgcaagtaatccagtcactgtatatgggtccatgtttgatgccggacgcctgtcttccaagtaacctacacattaa

SEQ ID NO: 520 - DNA, 200 bp, Ambrosia trifida
aaagctcggtgttctgtttctagtttgatttgttcaacatcttgtaaataaaggtcccaaaaagtcatcatattcaaagctttttgtagcaactggttgtttttttatgagatgattattggacaatttatgcacattttgatgtgtccttggtcccaactgagtcaactttattctcttcttgaattgtagaaaatacc

SEQ ID NO: 521 - DNA, 200 bp, Ambrosia trifida
ggtattttctacaattcaagaagagaataaagttgactcagttgggaccaaggacacatcaaaatgtgcataaattgtccaataatcatctcataaaaaaacaaccagttgctacaaaaagctttgaatatgatgactttttgggacctttatttacaagatgttgaacaaatcaaactagaaacagaacaccgagcttt

SEQ ID NO: 522 - DNA, 200 bp, Ambrosia trifida
ctcttcttgaattgtagaaaataccttcaggttttggggtaatctttatataaatatcgagcataaaacaccggcttgttaacttgatttgcctctgtgttttttaattcagcggcgtgcatgtggctactaaattagtaaggattaaagtgtagatgttgttaacttatcataaggctagaacgtgtgaacacgagcat

SEQ ID NO: 523 - DNA, 200 bp, Ambrosia trifida
atgctcgtgttcacacgttctagccttatgataagttaacaacatctacactttaatccttactaatttagtagccacatgcacgccgctgaattaaaaaacacagaggcaaatcaagttaacaagccggtgttttatgctcgatatttatataaagattaccccaaaacctgaaggtattttctacaattcaagaagag

SEQ ID NO: 524 - DNA, 200 bp, Ambrosia trifida
ggctagaacgtgtgaacacgagcatgatcaatataacaatggcaaggtccaaacccctgtcacttggaagtatgttggttggattggacggttataggtgttgagcatattattttgccaacccatcacgcgtatgatattttggtcccgacccgtttataatacgtcaacatgtatgtggtcattcatggttctatttg

SEQ ID NO: 525 - DNA, 200 bp, Ambrosia trifida
caaatagaaccatgaatgaccacatacatgttgacgtattataaacgggtcgggaccaaaatatcatacgcgtgatgggttggcaaaataatatgctcaacacctataaccgtccaatccaaccaacatacttccaagtgacaggggtttggaccttgccattgttatattgatcatgctcgtgttcacacgttctagcc

SEQ ID NO: 526 - DNA, 200 bp, Ambrosia trifida
ttttccctttttttattatatttatatttatttttatatttataaacaaccttttatattttatttgtacccattttacaacttccatttttctcccgccacataaccactttccggccacttctttggtgaaaatggcacaatgtttggcgccttcggtgcaatggcagatgaggttaacaaggagttcaatggaaaca

SEQ ID NO: 527 - DNA, 200 bp, Ambrosia trifida
tgtttccattgaactccttgttaacctcatctgccattgcaccgaaggcgccaaacattgtgccattttcaccaaagaagtggccggaaagtggttatgtggcgggagaaaaatggaagttgtaaaatgggtacaaataaaatataaaaggttgtttataaatataaaaataaatataaatataataaaaaaagggaaaa

SEQ ID NO: 528 - DNA, 200 bp, Ambrosia trifida
gttaacaaggagttcaatggaaacaagctctatgacctccaaaatgtggaactctttttctttgaagcagagcaagaaaggcgcgctcaaaacgtccacaaagtttagaatatgcgcttcgtcaaatggaaccattaacaggatggaagacctactaaacttggatgtatcgccttacaccgataagatcattgctgaat

SEQ ID NO: 529 - DNA, 200 bp, Ambrosia trifida
attcagcaatgatcttatcggtgtaaggcgatacatccaagtttagtaggtcttccatcctgttaatggttccatttgacgaagcgcatattctaaactttgtggacgttttgagcgcgcctttcttgctctgcttcaaagaaaaagagttccacattttggaggtcatagagcttgtttccattgaactccttgttaac

SEQ ID NO: 530 - DNA, 200 bp, Ambrosia trifida
tacaccgataagatcattgctgaatacatttggattgggggttctgggacagatgtgcgcagcaaatcaaggacaatctcgaaagcggttgagcatccttccgagcttccaaagtggaactatgatggatcaagtactggacaagcaccaggagaagatagtgaagttatcttatacccccaggcgatctttaaggatcc

SEQ ID NO: 531 - DNA, 200 bp, Ambrosia trifida
ggatccttaaagatcgcctgggggtataagataacttcactatcttctcctggtgcttgtccagtacttgatccatcatagttccactttggaagctcggaaggatgctcaaccgctttcgagattgtccttgatttgctgcgcacatctgtcccagaacccccaatccaaatgtattcagcaatgatcttatcggtgta

SEQ ID NO: 532 - DNA, 200 bp, Ambrosia trifida
acccccaggcgatctttaaggatcctttccgtggtgggaacaacatactggtcatatgtgatacatacacaccacaaggcgagcctatccctacaaacaaacgtgctaaggctgctgagattttcagtgatcctaaagttgtcgatcaagtgccctggtttggaattgagcaagagtacactttgcttcagccaaatgtg

SEQ ID NO: 533 - DNA, 200 bp, Ambrosia trifida
cacatttggctgaagcaaagtgtactcttgctcaattccaaaccagggcacttgatcgacaactttaggatcactgaaaatctcagcagccttagcacgtttgtttgtagggataggctcgccttgtggtgtgtatgtatcacatatgaccagtatgttgttcccaccacggaaaggatccttaaagatcgcctgggggt

SEQ ID NO: 534 - DNA, 200 bp, Ambrosia trifida
gtacactttgcttcagccaaatgtgaattggcctttgggttggccaacaggaggttaccctggtccacagggtccatactactgtggcgctggagcagataagtctttcggaagagacatatcggatgcacattacaaggcttgcctgtatgctggaattaacatcagtggaaccaacggcgaagttatgcccggacagt

SEQ ID NO: 535 - DNA, 200 bp, Ambrosia trifida
actgtccgggcataacttcgccgttggttccactgatgttaattccagcatacaggcaagccttgtaatgtgcatccgatatgtctcttccgaaagacttatctgctccagcgccacagtagtatggaccctgtggaccagggtaacctcctgttggccaacccaaaggccaattcacatttggctgaagcaaagtgtac

SEQ ID NO: 536 - DNA, 200 bp, Ambrosia trifida
aacggcgaagttatgcccggacagtgggaattccaagttggtcctagtgtcggaattgaagctggagaccatatctggtgtgctagatacctccttgagagaattactgagcaagccggtgttgtcctaacacttgaccctaaaccgattgagggagactggaatggcgcaggatgccacactaactacagtacaaaggc

SEQ ID NO: 537 - DNA, 200 bp, Ambrosia trifida
gcctttgtactgtagttagtgtggcatcctgcgccattccagtctccctcaatcggtttagggtcaagtgttaggacaacaccggcttgctcagtaattctctcaaggaggtatctagcacaccagatatggtctccagcttcaattccgacactaggaccaacttggaattcccactgtccgggcataacttcgccgtt

SEQ ID NO: 538 - DNA, 200 bp, Ambrosia trifida
gccacactaactacagtacaaaggccatgagagaagaaggtggatttgaggtgattaaaaaggcgattttgaacctttctcttcgccacaaagaacacatcagtgcttatggtgaaggaaacgagagaagattgactgggaaacacgaaactgccagcatcaaccaattttcatggggagtagctaaccgtggttgctca

SEQ ID NO: 539 - DNA, 200 bp, Ambrosia trifida
tgagcaaccacggttagctactccccatgaaaattggttgatgctggcagtttcgtgtttcccagtcaatcttctctcgtttccttcaccataagcactgatgtgttctttgtggcgaagagaaaggttcaaaatcgcctttttaatcacctcaaatccaccttcttctctcatggcctttgtactgtagttagtgtggc

SEQ ID NO: 540 - DNA, 200 bp, Ambrosia trifida
gggagtagctaaccgtggttgctcaatccgtgtgggtcgtgacactgagaaggccggcaaaggttacttggaagacaggcgtccggcatcaaacatggacccatatacagtgactggattacttgcagaaacaaccatcctgtgggagcctagtcttgaggccgaagcacttgctgcgcagaagttggcattgaatgtgt

SEQ ID NO: 541 - DNA, 200 bp, Ambrosia trifida
acacattcaatgccaacttctgcgcagcaagtgcttcggcctcaagactaggctcccacaggatggttgtttctgcaagtaatccagtcactgtatatgggtccatgtttgatgccggacgcctgtcttccaagtaacctttgccggccttctcagtgtcacgacccacacggattgagcaaccacggttagctactccc

SEQ ID NO: 542 - DNA, 200 bp, Ambrosia trifida
gcgcagaagttggcattgaatgtgtagactcaagtcaacccatgatcttcgaaagctcggtgttctgtttctagtttgatttcttcaacatcttgtaaataaaggtccccacgcttcatgttcaacgctatttttagcgactgggtgcttttttttacaaatggttactggacagtttatgcacattttgatgtgtcctt

SEQ ID NO: 543 - DNA, 200 bp, Ambrosia trifida
aaggacacatcaaaatgtgcataaactgtccagtaaccatttgtaaaaaaaagcacccagtcgctaaaaatagcgttgaacatgaagcgtggggacctttatttacaagatgttgaagaaatcaaactagaaacagaacaccgagctttcgaagatcatgggttgacttgagtctacacattcaatgccaacttctgcgc

SEQ ID NO: 544 - DNA, 200 bp, Chenopodium album
tcatattctgaaagtctcataaaaagagaaagatctctttattattttccaatcaatcaaccaaattgtttcatccaaatcccaaaaaaaatatgtcgcttctttcagatcttgttaacattaatctctcagactccactgataaggtcattgctgagtacatatggattggtggatctggtatggacatgagaagtaaa

SEQ ID NO: 545 - DNA, 200 bp, Chenopodium album
tttacttctcatgtccataccagatccaccaatccatatgtactcagcaatgaccttatcagtggagtctgagagattaatgttaacaagatctgaaagaagcgacatattttttttgggatttggatgaaacaatttggttgattgattggaaaataataaagagatctttctctttttatgagactttcagaatatga

SEQ ID NO: 546 - DNA, 200 bp, Chenopodium album
atctggtatggacatgagaagtaaagcaagaacactcaatggaccagtttctgatccaaaagagttgccaaaatggaattatgatggatctagcactggtcaagctcctggtgaagacagtgaagtcattctctacccacaagctatcttcaaagatccattcaggaggggcaacaatattcttgtcatgtgcgacgcat

SEQ ID NO: 547 - DNA, 200 bp, Chenopodium album
atgcgtcgcacatgacaagaatattgttgcccctcctgaatggatctttgaagatagcttgtgggtagagaatgacttcactgtcttcaccaggagcttgaccagtgctagatccatcataattccattttggcaactcttttggatcagaaactggtccattgagtgttcttgctttacttctcatgtccataccagat

SEQ ID NO: 548 - DNA, 200 bp, Chenopodium album
aatattcttgtcatgtgcgacgcatatacccctcaaggagaaccaatccccaccaacaagagacacgatgctgcaaagatattcagccatccaggtgtagctgctgagtgccttggtatggtatcgagcaggagtacaccttgctgcaaaaggacgttaattggcccattggctggcctgtcggaggttttcctggtcca

SEQ ID NO: 549 - DNA, 200 bp, Chenopodium album
tggaccaggaaaacctccgacaggccagccaatgggccaattaacgtccttttgcagcaaggtgtactcctgctcgataccataccaaggcactcagcagctacacctggatggctgaatatctttgcagcatcgtgtctcttgttggtggggattggttctccttgaggggtatatgcgtcgcacatgacaagaatatt

SEQ ID NO: 550 - DNA, 200 bp, Chenopodium album
gcctgtcggaggttttcctggtccacagggcccctactactgtggtattggtgctgataaagcttttggaagggacattgttgattcacactacaaggcttgcctttatgcaggaattaacattagtggaatcaatggagaagtgatgccaggacagtgggaattccaagtcggtccatcagttggaatctctgctggag

SEQ ID NO: 551 - DNA, 200 bp, Chenopodium album
ctccagcagagattccaactgatggaccgacttggaattcccactgtcctggcatcacttctccattgattccactaatgttaattcctgcataaaggcaagccttgtagtgtgaatcaacaatgtcccttccaaaagctttatcagcaccaataccacagtagtaggggccctgtggaccaggaaaacctccgacaggc

SEQ ID NO: 552 - DNA, 200 bp, Chenopodium album
ccatcagttggaatctctgctggagatgagttatgggtagctcgttacattttggagaggattactgagattgctggagtggctctttcttttgatccaaagccaattccaggtgattggaacggtgctggtgctcacacaaactacagcacaaagtccatgagggaagatggtggctatgaaatcattaaacaagctat

SEQ ID NO: 553 - DNA, 200 bp, Chenopodium album
atagcttgtttaatgatttcatagccaccatcttccctcatggactttgtgctgtagtttgtgtgagcaccagcaccgttccaatcacctggaattggctttggatcaaaagaaagagccactccagcaatctcagtaatcctctccaaaatgtaacgagctacccataactcatctccagcagagattccaactgatgg

SEQ ID NO: 554 - DNA, 200 bp, Chenopodium album
gctatgaaatcattaaacaagctattgaaaagcttggattaaggcacaaggaacacattgctgcttatggtgaaggaaatgaacgccgtctcactggtaaacacgaaacagccagcatttcaaccttcttgtggggagtagccaaccgaggtgcatcagttcgtgttggacgagacactgaaaaggagggaaaaggatat

SEQ ID NO: 555 - DNA, 200 bp, Chenopodium album
atatccttttccctccttttcagtgtctcgtccaacacgaactgatgcacctcggttggctactccccacaagaaggttgaaatgctggctgtttcgtgtttaccagtgagacggcgttcatttccttcaccataagcagcaatgtgttccttgtgccttaatccaagcttttcaatagcttgtttaatgatttcatagc

SEQ ID NO: 556 - DNA, 200 bp, Chenopodium album
cactgaaaaggagggaaaaggatatttcgaggacaggaggccggcttctaacatggacccttacgttgtcacttccatgattgcagaaaccactattctttggaaaccatagagtccaagcttcaatctttaaccaccctttctatattaagtcatttgctttaaatcagcagctgtctactcaagctgttaggattttt

SEQ ID NO: 557 - DNA, 200 bp, Chenopodium album
aaaaatcctaacagcttgagtagacagctgctgatttaaagcaaatgacttaatatagaaagggtggttaaagattgaagcttggactctatggtttccaaagaatagtggtttctgcaatcatggaagtgacaacgtaagggtccatgttagaagccggcctcctgtcctcgaaatatccttttccctccttttcagtg

SEQ ID NO: 558 - DNA, 200 bp, Commelina diffusa
ttgtttcagtattaaatttagaacaaatatttttagcttagggttagttcttgaacttatttagaatgctcgcaaaagtgtagtataatgtgaaggtatactttgttctagaacaatatttcttaagcttagcattagtccatgtatttaatttcagaatattagcaatagtatgtagtataatgtgaaggtgtactttg

SEQ ID NO: 559 - DNA, 200 bp, Commelina diffusa
caaagtacaccttcacattatactacatactattgctaatattctgaaattaaatacatggactaatgctaagcttaagaaatattgttctagaacaaagtataccttcacattatactacacttttgcgagcattctaaataagttcaagaactaaccctaagctaaaaatatttgttctaaatttaatactgaaacaa

SEQ ID NO: 560 - DNA, 200 bp, Commelina diffusa
tagtataatgtgaaggtgtactttgttttagaacaataatttttagcttggcaataatttcataatactagcaaaaatatagtataatttttagcttggcactaatttcaaaagtatagcaaaagtatagtataatttttagcttagcataagaccactttaattttaagttattcgcagaaaatacgtaaaatgtaaag

SEQ ID NO: 561 - DNA, 200 bp, Commelina diffusa
ctttacattttacgtattttctgcgaataacttaaaattaaagtggtcttatgctaagctaaaaattatactatacttttgctatacttttgaaattagtgccaagctaaaaattatactatatttttgctagtattatgaaattattgccaagctaaaaattattgttctaaaacaaagtacaccttcacattatacta

SEQ ID NO: 562 - DNA, 200 bp, Commelina diffusa
cgcagaaaatacgtaaaatgtaaagtaaggcatactttgtttcagtattaaatttagaacaatattttgtagcttagtattattccttgaacttaatatcagaatctttgcaaaatgtatgtataatgtgtaggcatactttgtttcaacattaaatttagaacaatacttctttagcttagcattatccctaaacttga

SEQ ID NO: 563 - DNA, 200 bp, Commelina diffusa
tcaagtttagggataatgctaagctaaagaagtattgttctaaatttaatgttgaaacaaagtatgcctacacattatacatacattttgcaaagattctgatattaagttcaaggaataatactaagctacaaaatattgttctaaatttaatactgaaacaaagtatgccttactttacattttacgtattttctgcg

SEQ ID NO: 564 - DNA, 200 bp, Commelina diffusa
agcttagcattatccctaaacttgattttcagaatactcataaaacttatataatgtgaattaaggtatactttgtttcagtgttgcctgaacttaattttagaacattcgaaaaagtataatataatgtgaaggcatactttatttcaatgttaaatttagaacactatttttcagctcagagaacattcacaaaagta

SEQ ID NO: 565 - DNA, 200 bp, Commelina diffusa
tacttttgtgaatgttctctgagctgaaaaatagtgttctaaatttaacattgaaataaagtatgccttcacattatattatactttttcgaatgttctaaaattaagttcaggcaacactgaaacaaagtataccttaattcacattatataagttttatgagtattctgaaaatcaagtttagggataatgctaagct

SEQ ID NO: 566 - DNA, 200 bp, Commelina diffusa
agctcagagaacattcacaaaagtacaatataatttcaacgggcatactttgtttcagtatcaaatttagtttcaatttgtgttcttatcaagtttttgtgctaaaaaataggattggagggacaggcatcgaccttcgaagcaaatcaagggtaagtacacagttaaaacctgcaaaaagtaatgtccaaatggtggtt

SEQ ID NO: 567 - DNA, 200 bp, Commelina diffusa
aaccaccatttggacattactttttgcaggttttaactgtgtacttacccttgatttgcttcgaaggtcgatgcctgtccctccaatcctattttttagcacaaaaacttgataagaacacaaattgaaactaaatttgatactgaaacaaagtatgcccgttgaaattatattgtacttttgtgaatgttctctgagct

SEQ ID NO: 568 - DNA, 200 bp, Commelina diffusa
aaaaagtaatgtccaaatggtggttctgctgtatcttttgtaagtgtttcgattgtgtttcagacgatatcgaagcctgtggagcacccgtcagagctgcccaagtggaactacgacgggtcgagcactgggcaggccccaggagaagacagtgaagtcatcttatagtaagatatctgcgccattaccattttatctta

SEQ ID NO: 569 - DNA, 200 bp, Commelina diffusa
taagataaaatggtaatggcgcagatatcttactataagatgacttcactgtcttctcctggggcctgcccagtgctcgacccgtcgtagttccacttgggcagctctgacgggtgctccacaggcttcgatatcgtctgaaacacaatcgaaacacttacaaaagatacagcagaaccaccatttggacattacttttt

SEQ ID NO: 570 - DNA, 200 bp, Commelina diffusa
tctgcgccattaccattttatcttatagtaagatatctgcgccgttaccattttaataagtaactgtaactgctcgcgctttgcagtcctcaggctatatttaaagacccatttcgcggaggaaaccacattttggtatgcatttcattataaacattacactaatctattcttgagttatctgtaactcaaagggtcta

SEQ ID NO: 571 - DNA, 200 bp, Commelina diffusa
tagaccctttgagttacagataactcaagaatagattagtgtaatgtttataatgaaatgcataccaaaatgtggtttcctccgcgaaatgggtctttaaatatagcctgaggactgcaaagcgcgagcagttacagttacttattaaaatggtaacggcgcagatatcttactataagataaaatggtaatggcgcaga

SEQ ID NO: 572 - DNA, 200 bp, Commelina diffusa
agttatctgtaactcaaagggtctaaatattgagtccagactactgtcgttcttcaactaatgaacaactaattcaggtgatctgcgacacgtatacgccggccggggagccaataccgacaaacaagaggcacagggctgcccagatattcagcgacaagaaggtcgtcgacgaagtaccatggtaagtcctggcctca

SEQ ID NO: 573 - DNA, 200 bp, Commelina diffusa
tgaggccaggacttaccatggtacttcgtcgacgaccttcttgtcgctgaatatctgggcagccctgtgcctcttgtttgtcggtattggctccccggccggcgtatacgtgtcgcagatcacctgaattagttgttcattagttgaagaacgacagtagtctggactcaatatttagaccctttgagttacagataact

SEQ ID NO: 574 - DNA, 200 bp, Commelina diffusa
agtaccatggtaagtcctggcctcagcagttttagttgagtacatggtttaatattgtccctactaaaatttattttttgatgacaaatccgaaaccttcaggttcggtattgagcaggagtacaccttgctccagacaaatgtgaactggcctcttggatggcccgtcggagggtaccccgggccccaggtaacatttt

SEQ ID NO: 575 - DNA, 200 bp, Commelina diffusa
aaaatgttacctggggcccggggtaccctccgacgggccatccaagaggccagttcacatttgtctggagcaaggtgtactcctgctcaataccgaacctgaaggtttcggatttgtcatcaaaaaataaattttagtagggacaatattaaaccatgtactcaactaaaactgctgaggccaggacttaccatggtact

SEQ ID NO: 576 - DNA, 200 bp, Commelina diffusa
taccccgggccccaggtaacatttttttctgttacttagtaattacaacactagtcatttggtaacgcagtttggctgtcaccaaagcctgtgtctgtgagattttattacaattcagcacctttacagcttcagaccgttgagacaatctcctcaatttgtagccaaaacttgagagaaaaccaaagctataaattgac

SEQ ID NO: 577 - DNA, 200 bp, Commelina diffusa
gtcaatttatagctttggttttctctcaagttttggctacaaattgaggagattgtctcaacggtctgaagctgtaaaggtgctgaattgtaataaaatctcacagacacaggctttggtgacagccaaactgcgttaccaaatgactagtgttgtaattactaagtaacagaaaaaaatgttacctggggcccggggta

SEQ ID NO: 578 - DNA, 200 bp, Commelina diffusa
gagaaaaccaaagctataaattgacaaatttagtccataagacctatcatacacctatatatagcctagcatcccagctgtaaaaaatgtctcgctccaagcagcctacaacactacaacttggaacttgcaaaactttagaatcccagttagatacattatcgacaacagggttgcaaccagtcagcaattccagcaga

SEQ ID NO: 579 - DNA, 200 bp, Commelina diffusa
tctgctggaattgctgactggttgcaaccctgttgtcgataatgtatctaactgggattctaaagttttgcaagttccaagttgtagtgttgtaggctgcttggagcgagacattttttacagctgggatgctaggctatatataggtgtatgataggtcttatggactaaatttgtcaatttatagctttggttttctc

SEQ ID NO: 580 - DNA, 200 bp, Commelina diffusa
gcaaccagtcagcaattccagcagaattccagtagctttatcgcaccagcttccaagttttttccaccgtctttgcaacttctatgtgaaacaaaatgtcgacacaaagactaacaatcaaattccgaagctgaacattcacagttactgtcacattttatgtcgtcgaaatgttatttctcttagtacctgaaatgtta

SEQ ID NO: 581 - DNA, 200 bp, Commelina diffusa
taacatttcaggtactaagagaaataacatttcgacgacataaaatgtgacagtaactgtgaatgttcagcttcggaatttgattgttagtctttgtgtcgacattttgtttcacatagaagttgcaaagacggtggaaaaaacttggaagctggtgcgataaagctactggaattctgctggaattgctgactggttgc

SEQ ID NO: 582 - DNA, 200 bp, Commelina diffusa
atttctcttagtacctgaaatgttagctgaattcaagaaatgtaaagatcaacgtggagtctaggaaatgttattcctattagttcttatcaaaatattgaatactttcagggcccctactactgtgctgttggcgcggacaagtccttcgggagggacatctcggatgctcactacaaggcctgcctttacgccggcat

SEQ ID NO: 583 - DNA, 200 bp, Commelina diffusa
atgccggcgtaaaggcaggccttgtagtgagcatccgagatgtccctcccgaaggacttgtccgcgccaacagcacagtagtaggggccctgaaagtattcaatattttgataagaactaataggaataacatttcctagactccacgttgatctttacatttcttgaattcagctaacatttcaggtactaagagaaat

SEQ ID NO: 584 - DNA, 200 bp, Commelina diffusa
acaaggcctgcctttacgccggcatcaacataagtggcactaacggagaagttatgcctggtcaggtgcggaattcatttcatttcagctcattttgatttgaacatacccgaaaaaataaattcctgaaattttattcaaatctgaacatgaccaacattagggcacgccattgtacttctcacaagcttctcggattt

SEQ ID NO: 585 - DNA, 200 bp, Commelina diffusa
aaatccgagaagcttgtgagaagtacaatggcgtgccctaatgttggtcatgttcagatttgaataaaatttcaggaatttattttttcgggtatgttcaaatcaaaatgagctgaaatgaaatgaattccgcacctgaccaggcataacttctccgttagtgccacttatgttgatgccggcgtaaaggcaggccttgt

SEQ ID NO: 586 - DNA, 200 bp, Commelina diffusa
tacttctcacaagcttctcggattttatctgtagtgcttggaaatgctgctaaaatctttgactttctcttactgtctataaaaatatgttgatagtttgggaatttcagataagtactattttagctgtgaaattaaaatacagtgtactgaccaatcgatggattctgtagtgggagttccaagtcgggccgagtgtt

SEQ ID NO: 587 - DNA, 200 bp, Commelina diffusa
aacactcggcccgacttggaactcccactacagaatccatcgattggtcagtacactgtattttaatttcacagctaaaatagtacttatctgaaattcccaaactatcaacatatttttatagacagtaagagaaagtcaaagattttagcagcatttccaagcactacagataaaatccgagaagcttgtgagaagta

SEQ ID NO: 588 - DNA, 200 bp, Commelina diffusa
ggagttccaagtcgggccgagtgttggaattgaagcaggagatcacatatggtgtgcaagataccttcttgaggtaatttgggaacatttttcttagttttataaaattaagagtcgaaaaaaccatacattataacttatacggttgaactcagactcaaactcgattgacatttttttttagtcttcaaagatgttcc

SEQ ID NO: 589 - DNA, 200 bp, Commelina diffusa
ggaacatctttgaagactaaaaaaaaatgtcaatcgagtttgagtctgagttcaaccgtataagttataatgtatggttttttcgactcttaattttataaaactaagaaaaatgttcccaaattacctcaagaaggtatcttgcacaccatatgtgatctcctgcttcaattccaacactcggcccgacttggaactcc

SEQ ID NO: 590 - DNA, 200 bp, Commelina diffusa
tttttttagtcttcaaagatgttcccaaaattcggaagaaaaagtaataattaagagaacatacttgcaacgtacctaaaggcacaaagtttttccctttttgcgatatctgactaattctttgcattacatgtattaactatttcaaaattactcagagaatcaccgagcaagcgggcgttgttctctcagttgaccca

SEQ ID NO: 591 - DNA, 200 bp, Commelina diffusa
tgggtcaactgagagaacaacgcccgcttgctcggtgattctctgagtaattttgaaatagttaatacatgtaatgcaaagaattagtcagatatcgcaaaaagggaaaaactttgtgcctttaggtacgttgcaagtatgttctcttaattattactttttcttccgaattttgggaacatctttgaagactaaaaaaa

SEQ ID NO: 592 - DNA, 200 bp, Commelina diffusa
gggcgttgttctctcagttgacccaaagccgattgaggtacttctaaaggcagttgcagaaagcctgaaagaaaaaagcattatcgtgaataacttcttctaaagactcaaaaaatttattttattttatttttgtttagggtgactggaatggcgcgggttgtcacactaactacaggtgactgaaaaaacacacattt

SEQ ID NO: 593 - DNA, 200 bp, Commelina diffusa
aaatgtgtgttttttcagtcacctgtagttagtgtgacaacccgcgccattccagtcaccctaaacaaaaataaaataaaataaattttttgagtctttagaagaagttattcacgataatgcttttttctttcaggctttctgcaactgcctttagaagtacctcaatcggctttgggtcaactgagagaacaacgccc

SEQ ID NO: 594 - DNA, 200 bp, Commelina diffusa
caggtgactgaaaaaacacacatttatttatttatttatttatttattttgacgatactgaatgaagaactaagtcagaatatgtgactaattaacgtgtagcacaaagagcatgagggaagagggcggcttcgaggtaataaagaaggcaattctgaacctttctcttcggcacaaggagcacataagcgcatacggag

SEQ ID NO: 595 - DNA, 200 bp, Commelina diffusa
ctccgtatgcgcttatgtgctccttgtgccgaagagaaaggttcagaattgccttctttattacctcgaagccgccctcttccctcatgctctttgtgctacacgttaattagtcacatattctgacttagttcttcattcagtatcgtcaaaataaataaataaataaataaataaatgtgtgttttttcagtcacctg

SEQ ID NO: 596 - DNA, 200 bp, Commelina diffusa
aaggagcacataagcgcatacggagaggggaatgagcgaaggttgacaggcaaacacgagacagccagcattaacactttctcttgggtacagacaagcatttccctgaaatttactcaactgttgtgaatttttttttgggttgaaattttgatatgttttgtgtttaaagggagttgcaaaccgtggttgctccattc

SEQ ID NO: 597 - DNA, 200 bp, Commelina diffusa
gaatggagcaaccacggtttgcaactccctttaaacacaaaacatatcaaaatttcaacccaaaaaaaaattcacaacagttgagtaaatttcagggaaatgcttgtctgtacccaagagaaagtgttaatgctggctgtctcgtgtttgcctgtcaaccttcgctcattcccctctccgtatgcgcttatgtgctcctt

SEQ ID NO: 598 - DNA, 200 bp, Commelina diffusa
gttgcaaaccgtggttgctccattcgtgtgggacgggacacagagaaagaaggcaaaggtatggagcttaaattacgagattaagtattgttttacatagaagcttcagacgagctcaaaaaatggctttaagctcattcacattgctatattaattttttaaaaagaaggaaatcttagattacgagattaggtagtgt

SEQ ID NO: 599 - DNA, 200 bp, Commelina diffusa
acactacctaatctcgtaatctaagatttccttctttttaaaaaattaatatagcaatgtgaatgagcttaaagccattttttgagctcgtctgaagcttctatgtaaaacaatacttaatctcgtaatttaagctccatacctttgccttctttctctgtgtcccgtcccacacgaatggagcaaccacggtttgcaac

SEQ ID NO: 600 - DNA, 200 bp, Commelina diffusa
cttagattacgagattaggtagtgtcatatacagaagcttcaatggagctcaataatggttttaagcgcgcattcatacatgctagattcagtattgaaatggtttatttattttgctatagaatttttagaggagttcaaaaatgattataagtgtacattcacagatgctaggttttgtattgaaatgattatttttt

SEQ ID NO: 601 - DNA, 200 bp, Commelina diffusa
aaaaaataatcatttcaatacaaaacctagcatctgtgaatgtacacttataatcatttttgaactcctctaaaaattctatagcaaaataaataaaccatttcaatactgaatctagcatgtatgaatgcgcgcttaaaaccattattgagctccattgaagcttctgtatatgacactacctaatctcgtaatctaag

SEQ ID NO: 602 - DNA, 200 bp, Commelina diffusa
ttttgtattgaaatgattattttttttttaatagaagctttagaggaactaagaaatagtttaagcacgcatccacgtgctagattgaaatgattatttctttaactacaaaagcttcagatgaattagagatgacaatcaagtgtcgcattcactatattcacatatgctagattttttgtattgaaatgattatttct

SEQ ID NO: 603 - DNA, 200 bp, Commelina diffusa
agaaataatcatttcaatacaaaaaatctagcatatgtgaatatagtgaatgcgacacttgattgtcatctctaattcatctgaagcttttgtagttaaagaaataatcatttcaatctagcacgtggatgcgtgcttaaactatttcttagttcctctaaagcttctattaaaaaaaaaataatcatttcaatacaaaa

SEQ ID NO: 604 - DNA, 200 bp, Commelina diffusa
tttttgtattgaaatgattatttctttcactatagaagcttcaggagctaaaaaatggttttaagcacagactcgctatattctgtactgaaattatttctttcatcgtagaagcttcggaggaacttaaaaatgactttaagtgtgcattcacacatctagatttatattgaaatgattatttctttcactatagaagc

SEQ ID NO: 605 - DNA, 200 bp, Commelina diffusa
gcttctatagtgaaagaaataatcatttcaatataaatctagatgtgtgaatgcacacttaaagtcatttttaagttcctccgaagcttctacgatgaaagaaataatttcagtacagaatatagcgagtctgtgcttaaaaccattttttagctcctgaagcttctatagtgaaagaaataatcatttcaatacaaaaa

SEQ ID NO: 606 - DNA, 200 bp, Commelina diffusa
tgattatttctttcactatagaagcttcagacgagcttaaaaatcttaagcacatatgctagattttgtatcgaaatgattatatctttcgctatagaagatttagatgagctcaaaaatggcattgagcgggcactcacatatgctagattctatattgaaatgatttattctttcactatatatagaagttttagatg

SEQ ID NO: 607 - DNA, 200 bp, Commelina diffusa
catctaaaacttctatatatagtgaaagaataaatcatttcaatatagaatctagcatatgtgagtgcccgctcaatgccatttttgagctcatctaaatcttctatagcgaaagatataatcatttcgatacaaaatctagcatatgtgcttaagatttttaagctcgtctgaagcttctatagtgaaagaaataatca

SEQ ID NO: 608 - DNA, 200 bp, Commelina diffusa
tcactatatatagaagttttagatgaactcagatatgactttaagcatgcattcttacatgataaattctatattgaaatgattatttctttcactataaatagaagctttagttgaactcacatatgctagattctgtattgaaatgattatttctttcaccatatatagaatctttagagaaattcaacaataacttt

SEQ ID NO: 609 - DNA, 200 bp, Commelina diffusa
aaagttattgttgaatttctctaaagattctatatatggtgaaagaaataatcatttcaatacagaatctagcatatgtgagttcaactaaagcttctatttatagtgaaagaaataatcatttcaatatagaatttatcatgtaagaatgcatgcttaaagtcatatctgagttcatctaaaacttctatatatagtga

SEQ ID NO: 610 - DNA, 200 bp, Commelina diffusa
tttagagaaattcaacaataacttttgagtgtgcattcacatattctttattcaaatgattatttcattcgctatagaaactttacatgagctccaaaatgttttttaagtgcgcaatcacatatgctagattctgtattgaaatgatgatttctttcactatatatagaagctttagataaactaaaaaatgattttaa

SEQ ID NO: 611 - DNA, 200 bp, Commelina diffusa
ttaaaatcattttttagtttatctaaagcttctatatatagtgaaagaaatcatcatttcaatacagaatctagcatatgtgattgcgcacttaaaaaacattttggagctcatgtaaagtttctatagcgaatgaaataatcatttgaataaagaatatgtgaatgcacactcaaaagttattgttgaatttctctaaa

SEQ ID NO: 612 - DNA, 200 bp, Commelina diffusa
tagataaactaaaaaatgattttaactacacagtcacatttgctagattctgtattgaaatgattttttcttccattatatatagaagctttagatgaactaaaaaatgattcaaagttaacattacatatgctagattctgtattgaaatgattatgtctttcactatatagagaagctttagatgaactccaaactgg

SEQ ID NO: 613 - DNA, 200 bp, Commelina diffusa
ccagtttggagttcatctaaagcttctctatatagtgaaagacataatcatttcaatacagaatctagcatatgtaatgttaactttgaatcattttttagttcatctaaagcttctatatataatggaagaaaaaatcatttcaatacagaatctagcaaatgtgactgtgtagttaaaatcattttttagtttatcta

SEQ ID NO: 614 - DNA, 200 bp, Commelina diffusa
aagctttagatgaactccaaactggctttaaacgcacattcacagatgctagatcctatattggaatgattatttcttcactacatatagaagcttgagatgaactaaaaaatgatttaaagtgcacattcacatatgctagatcctatattgaaatgattatttcttcactaaatatagaagcttgagatgaactaaaa

SEQ ID NO: 615 - DNA, 200 bp, Commelina diffusa
ttttagttcatctcaagcttctatatttagtgaagaaataatcatttcaatataggatctagcatatgtgaatgtgcactttaaatcattttttagttcatctcaagcttctatatgtagtgaagaaataatcattccaatataggatctagcatctgtgaatgtgcgtttaaagccagtttggagttcatctaaagctt

SEQ ID NO: 616 - DNA, 200 bp, Commelina diffusa
tatagaagcttgagatgaactaaaaaatgatttaaagtgcacattcacacatgctagattttgtattgaaatgattatttctttcattccatataaaagctttctccaatggctttaaattctcattcacatatgctagatcctatattgaaatgattatttcttcactacatatagaagcttgagatgaactaaataat

SEQ ID NO: 617 - DNA, 200 bp, Commelina diffusa
attatttagttcatctcaagcttctatatgtagtgaagaaataatcatttcaatataggatctagcatatgtgaatgagaatttaaagccattggagaaagcttttatatggaatgaaagaaataatcatttcaatacaaaatctagcatgtgtgaatgtgcactttaaatcattttttagttcatctcaagcttctata

SEQ ID NO: 618 - DNA, 200 bp, Commelina diffusa
agaagcttgagatgaactaaataatgattcaaagtgcacattcacacgctagattttgtattgaaatgattattgctttcactacatatagaagctttagatgaactaaaaattaacttagtgcacattcacatatgttagatcttatatcgaaataattaattttcaactacagaagcttcagaagagctcaaaaaatg

SEQ ID NO: 619 - DNA, 200 bp, Commelina diffusa
cattttttgagctcttctgaagcttctgtagttgaaaattaattatttcgatataagatctaacatatgtgaatgtgcactaagttaatttttagttcatctaaagcttctatatgtagtgaaagcaataatcatttcaatacaaaatctagcgtgtgaatgtgcactttgaatcattatttagttcatctcaagcttct

SEQ ID NO: 620 - DNA, 200 bp, Commelina diffusa
aagcttcagaagagctcaaaaaatggctttaagtgcttattcatacatttttactaccttctatattgaaatgattatttctttcactatagtatgacactcatttacacaattacaccacaaatacaggatatttggaagatcgccgcccggcgtcaaacatggacccatatgttgttactgccttgctagcagaaacc

SEQ ID NO: 621 - DNA, 200 bp, Commelina diffusa
ggtttctgctagcaaggcagtaacaacatatgggtccatgtttgacgccgggcggcgatcttccaaatatcctgtatttgtggtgtaattgtgtaaatgagtgtcatactatagtgaaagaaataatcatttcaatatagaaggtagtaaaaatgtatgaataagcacttaaagccattttttgagctcttctgaagctt

SEQ ID NO: 622 - DNA, 200 bp, Commelina diffusa
tgttactgccttgctagcagaaaccactcttctttgggagccaacactagaagctgaggctttagctgcccagaagttggcactgcaggtgtgagatggtggccatgaagttgaggtctagccatgaaatgttaatgtccaaagaattcaatcgttcactgaattcagcctctcctgaatgtttgttgtcatcttacatt

SEQ ID NO: 623 - DNA, 200 bp, Commelina diffusa
aatgtaagatgacaacaaacattcaggagaggctgaattcagtgaacgattgaattctttggacattaacatttcatggctagacctcaacttcatggccaccatctcacacctgcagtgccaacttctgggcagctaaagcctcagcttctagtgttggctcccaaagaagagtggtttctgctagcaaggcagtaaca

SEQ ID NO: 624 - DNA, 200 bp, Commelina diffusa
tgaatgtttgttgtcatcttacattaattcctcttgatttttatgttgttggagctgtttttttcttgtggtaatgttcagtttctccatcacaaggagtatggcactagagagaatataattatcaataattatatttatgaaatggactgtatttatttttatatattaacgggatggataacttgaaacaagtattt

SEQ ID NO: 625 - DNA, 200 bp, Commelina diffusa
aaatacttgtttcaagttatccatcccgttaatatataaaaataaatacagtccatttcataaatataattattgataattatattctctctagtgccatactccttgtgatggagaaactgaacattaccacaagaaaaaaacagctccaacaacataaaaatcaagaggaattaatgtaagatgacaacaaacattca

SEQ ID NO: 626 - DNA, 200 bp, Commelina diffusa
gatggataacttgaaacaagtatttgtgtttatgctctgggtgttgattgactagtattaatactagcaatcataactcctaacagagctgcgaaactttgaacccggaacctcctggagagataagatgcggtggtttgcgaaatgaaatgcaatggttgttgggttgaggcatatgtatggaagtcatgcatatgatg

SEQ ID NO: 627 - DNA, 200 bp, Commelina diffusa
catcatatgcatgacttccatacatatgcctcaacccaacaaccattgcatttcatttcgcaaaccaccgcatcttatctctccaggaggttccgggttcaaagtttcgcagctctgttaggagttatgattgctagtattaatactagtcaatcaacacccagagcataaacacaaatacttgtttcaagttatccatc

SEQ ID NO: 628 - DNA, 200 bp, Commelina diffusa
atgtatggaagtcatgcatatgatgctttgtgtcagggttgcaagtattggtttttgggataggtataggttctaaataatccaatgcataacaatatcaatagctatccacatcagatttgttattagatacaatgaaacaaataatatggacaaaaaataagttttaaatggaatttttttttcttatatggtttcgg

SEQ ID NO: 629 - DNA, 200 bp, Commelina diffusa
ccgaaaccatataagaaaaaaaaattccatttaaaacttattttttgtccatattatttgtttcattgtatctaataacaaatctgatgtggatagctattgatattgttatgcattggattatttagaacctatacctatcccaaaaaccaatacttgcaaccctgacacaaagcatcatatgcatgacttccatacat

SEQ ID NO: 630 - DNA, 200 bp, Commelina diffusa
atttttttttcttatatggtttcggctcaaactaactaaaattacacgaatacgaccaattttgccttatctattatcaaaatcgactcatcgaccaacttaaaaaattgaaccaataatttgtaggggcgaatggcccgaggggcatatttgactcgcatcaggggaagttttacaaccgaacataaacaaacgccatt

SEQ ID NO: 631 - DNA, 200 bp, Commelina diffusa
aatggcgtttgtttatgttcggttgtaaaacttcccctgatgcgagtcaaatatgcccctcgggccattcgcccctacaaattattggttcaattttttaagttggtcgatgagtcgattttgataatagataaggcaaaattggtcgtattcgtgtaattttagttagtttgagccgaaaccatataagaaaaaaaaat

SEQ ID NO: 632 - DNA, 200 bp, Commelina diffusa
caaccgaacataaacaaacgccattgcaacaaaggatattatgagaaaccgtggtatgttggtgggcgcaacttatgtgtcatgtggcggggatgaaactgcttcccacctgttgatgttcggtattcaagccttacctaatgtgagtctgacttagcttggttattcggttcggcccagatgtgggttcaagggggagt

SEQ ID NO: 633 - DNA, 200 bp, Commelina diffusa
actcccccttgaacccacatctgggccgaaccgaataaccaagctaagtcagactcacattaggtaaggcttgaataccgaacatcaacaggtgggaagcagtttcatccccgccacatgacacataagttgcgcccaccaacataccacggtttctcataatatcctttgttgcaatggcgtttgtttatgttcggttg

SEQ ID NO: 634 - DNA, 200 bp, Commelina diffusa
cccagatgtgggttcaagggggagtacctccggtccaatttggtccttctcttaaggtcgggagtcacctgcaagacccgtggatgttgccctcggggtagagcctctaacgctcaagtcagttatttggtccctaaaagagtgcacgagagagagagagagatacctgtggagatatggagtatttatagctcctgtca

SEQ ID NO: 635 - DNA, 200 bp, Commelina diffusa
tgacaggagctataaatactccatatctccacaggtatctctctctctctctcgtgcactcttttagggaccaaataactgacttgagcgttagaggctctaccccgagggcaacatccacgggtcttgcaggtgactcccgaccttaagagaaggaccaaattggaccggaggtactcccccttgaacccacatctggg

SEQ ID NO: 636 - DNA, 200 bp, Commelina diffusa
tttttaagctccttcaaatcatccattcccacattgccatttccatttcctcaatctcttgaaatgatggctcaaatgatggcaagtcctatgcattgccagatgcggcttccgggcaaatccatgagttccaagcctttactggattcgaaaatgtggagctctctgctgctcaactcccagaagagcaagaccaagag

SEQ ID NO: 637 - DNA, 200 bp, Commelina diffusa
ctcttggtcttgctcttctgggagttgagcagcagagagctccacattttcgaatccagtaaaggcttggaactcatggatttgcccggaagccgcatctggcaatgcataggacttgccatcatttgagccatcatttcaagagattgaggaaatggaaatggcaatgtgggaatggatgatttgaaggagcttaaaaa

SEQ ID NO: 638 - DNA, 200 bp, Commelina diffusa
actcccagaagagcaagaccaagaggaggaccatcaacttcagggtgagcgcaaagttcgagaatggcgttgtgccgaggatggaagatcttctcaatttggacactagcccctacactgacaaaatcatagcagaatatatttggattggagggacaggcatcgaccttcgaagcaaatcaaggacgatatcgaagcct

SEQ ID NO: 639 - DNA, 200 bp, Commelina diffusa
aggcttcgatatcgtccttgatttgcttcgaaggtcgatgcctgtccctccaatccaaatatattctgctatgattttgtcagtgtaggggctagtgtccaaattgagaagatcttccatcctcggcacaacgccattctcgaactttgcgctcaccctgaagttgatggtcctcctcttggtcttgctcttctgggagt

SEQ ID NO: 640 - DNA, 200 bp, Commelina diffusa
caaatcaaggacgatatcgaagcctgtggagcacccgtcagagctgcccaagtggaactacgacgggtcgagcactgggcaggccccaggagaagacagtgaagtcatcttatatcctcaggctatatttaaagacccatttcgcggaggaaaccacattttggtgatctgcgacacgtatacgccggccggggagccaa

SEQ ID NO: 641 - DNA, 200 bp, Commelina diffusa
ttggctccccggccggcgtatacgtgtcgcagatcaccaaaatgtggtttcctccgcgaaatgggtctttaaatatagcctgaggatataagatgacttcactgtcttctcctggggcctgcccagtgctcgacccgtcgtagttccacttgggcagctctgacgggtgctccacaggcttcgatatcgtccttgatttg

SEQ ID NO: 642 - DNA, 200 bp, Commelina diffusa
acgtatacgccggccggggagccaataccgacaaacaagaggcacagggctgcccagatattcagcgacaagaaggtcgtcgacgaagtaccatggttcggtattgagcaggagtacaccttgctccagacaaatgtgaactggcctcttggatggcccgtcggagggtaccccgggccccagggcccctactactgtgc

SEQ ID NO: 643 - DNA, 200 bp, Commelina diffusa
gcacagtagtaggggccctggggcccggggtaccctccgacgggccatccaagaggccagttcacatttgtctggagcaaggtgtactcctgctcaataccgaaccatggtacttcgtcgacgaccttcttgtcgctgaatatctgggcagccctgtgcctcttgtttgtcggtattggctccccggccggcgtatacgt

SEQ ID NO: 644 - DNA, 200 bp, Commelina diffusa
ggccccagggcccctactactgtgctgttggcgcggacaagtccttcgggagggacatctcggatgctcactacaaggcctgcctttacgccggcatcaacataagtggcactaacggagaagttatgcctggtcagtgggagttccaagtcgggccgagtgttggaattgaagcaggagatcacatatggtgtgcaaga

SEQ ID NO: 645 - DNA, 200 bp, Commelina diffusa
tcttgcacaccatatgtgatctcctgcttcaattccaacactcggcccgacttggaactcccactgaccaggcataacttctccgttagtgccacttatgttgatgccggcgtaaaggcaggccttgtagtgagcatccgagatgtccctcccgaaggacttgtccgcgccaacagcacagtagtaggggccctggggcc

SEQ ID NO: 646 - DNA, 200 bp, Commelina diffusa
aggagatcacatatggtgtgcaagataccttcttgagagaatcaccgagcaagcgggcgttgttctctcagttgacccaaagccgattgagggtgactggaatggcgcgggttgtcacactaactacagcacaaagagcatgagggaagagggcggcttcgaggtaataaagaaggcaattctgaacctttctcttcggc

SEQ ID NO: 647 - DNA, 200 bp, Commelina diffusa
gccgaagagaaaggttcagaattgccttctttattacctcgaagccgccctcttccctcatgctctttgtgctgtagttagtgtgacaacccgcgccattccagtcaccctcaatcggctttgggtcaactgagagaacaacgcccgcttgctcggtgattctctcaagaaggtatcttgcacaccatatgtgatctcct

SEQ ID NO: 648 - DNA, 200 bp, Commelina diffusa
gcaattctgaacctttctcttcggcacaaggagcacataagcgcatacggagaggggaatgagcgaaggttgacaggcaaacacgagacagccagcattaacactttctcttggggagttgcaaaccgtggttgctccattcgtgtgggacgggacacagagaaagaaggcaaaggatatttggaagatcgccgcccggc

SEQ ID NO: 649 - DNA, 200 bp, Commelina diffusa
gccgggcggcgatcttccaaatatcctttgccttctttctctgtgtcccgtcccacacgaatggagcaaccacggtttgcaactccccaagagaaagtgttaatgctggctgtctcgtgtttgcctgtcaaccttcgctcattcccctctccgtatgcgcttatgtgctccttgtgccgaagagaaaggttcagaattgc

SEQ ID NO: 650 - DNA, 200 bp, Commelina diffusa
gatatttggaagatcgccgcccggcgtcaaacatggacccatatgttgttactgccttgctagcagaaaccactcttctttgggagccaacactagaagctgaggctttagctgcccagaagttggcactgcaggtgtgagatggtggccatgaagttgaggtctagccatgaaatgttaatgtccaaagaattcaatcg

SEQ ID NO: 651 - DNA, 200 bp, Commelina diffusa
cgattgaattctttggacattaacatttcatggctagacctcaacttcatggccaccatctcacacctgcagtgccaacttctgggcagctaaagcctcagcttctagtgttggctcccaaagaagagtggtttctgctagcaaggcagtaacaacatatgggtccatgtttgacgccgggcggcgatcttccaaatatc

SEQ ID NO: 652 - DNA, 200 bp, Convulvulus arvensis
aagaatatactctccttcaaaaagatgttaattggccacttgggtggcctgctggaggttatcctggtccacagggaccatactactgtggaattggagccgataaggcttttgggcgtgacattgtcgactcgcactataaggcctgcctttacgcggggattaacatcagcggtatcaatggcgaagtgatgcctgga

SEQ ID NO: 653 - DNA, 200 bp, Convulvulus arvensis
tccaggcatcacttcgccattgataccgctgatgttaatccccgcgtaaaggcaggccttatagtgcgagtcgacaatgtcacgcccaaaagccttatcggctccaattccacagtagtatggtccctgtggaccaggataacctccagcaggccacccaagtggccaattaacatctttttgaaggagagtatattctt

SEQ ID NO: 654 - DNA, 200 bp, Convulvulus arvensis
tatcaatggcgaagtgatgcctggacagtgggaattccaagttggaccggctgttggcatctcagctggcgatgaggtgtgggtagctcgctatattctcgagaggatttctgagattgctggagttgttgtctcattcgaccccaaacctatcccgggtgattggaatggtgctggagctcacacaaactacagcacta

SEQ ID NO: 655 - DNA, 200 bp, Convulvulus arvensis
tagtgctgtagtttgtgtgagctccagcaccattccaatcacccgggataggtttggggtcgaatgagacaacaactccagcaatctcagaaatcctctcgagaatatagcgagctacccacacctcatcgccagctgagatgccaacagccggtccaacttggaattcccactgtccaggcatcacttcgccattgata

SEQ ID NO: 656 - DNA, 200 bp, Convulvulus arvensis
ggagctcacacaaactacagcactaagtcaatgaggaatgagggtggatttgaagtcatcaagaaggcaattgcaaagcttcaggtgaggcacaaggagcacattgctgcatatggtgagggcaacgagcgccgcttgaccggaaaacacgagacagctgacatcaacaccttctcatggggagttgcgaataggggtgc

SEQ ID NO: 657 - DNA, 200 bp, Convulvulus arvensis
gcacccctattcgcaactccccatgagaaggtgttgatgtcagctgtctcgtgttttccggtcaagcggcgctcgttgccctcaccatatgcagcaatgtgctccttgtgcctcacctgaagctttgcaattgccttcttgatgacttcaaatccaccctcattcctcattgacttagtgctgtagtttgtgtgagctcc

SEQ ID NO: 658 - DNA, 200 bp, Conyza canadensis
aaaaaaaaactttaacctttttatgatcatgtggtttgaaaagatggggcttgaaaaggttcaaaattttagacctttccaaaattagataatttattatttttttctttttaagaattaagacatttaatttatttagaaagctataagtgttgaatcatcatgaaaattggcttataaaaatatgttaatattaatat

SEQ ID NO: 659 - DNA, 200 bp, Conyza canadensis
atattaatattaacatatttttataagccaattttcatgatgattcaacacttatagctttctaaataaattaaatgtcttaattcttaaaaagaaaaaaataataaattatctaattttggaaaggtctaaaattttgaaccttttcaagccccatcttttcaaaccacatgatcataaaaaggttaaagttttttttt

SEQ ID NO: 660 - DNA, 200 bp, Conyza canadensis
tataaaaatatgttaatattaatattatgaaccttcagaaagattttatgccataaatattttttatgtatgatgactgatgatattgtgtaaatatcatagattgaagaccctttcaaactttaaaaacggtgttgatatcatcactatttagaaaaagaactctttttttttttaatgtgatttatctcaaacttttt

SEQ ID NO: 661 - DNA, 200 bp, Conyza canadensis
aaaaagtttgagataaatcacattaaaaaaaaaaagagttctttttctaaatagtgatgatatcaacaccgtttttaaagtttgaaagggtcttcaatctatgatatttacacaatatcatcagtcatcatacataaaaaatatttatggcataaaatctttctgaaggttcataatattaatattaacatatttttata

SEQ ID NO: 662 - DNA, 200 bp, Conyza canadensis
taatgtgatttatctcaaactttttatttaaatcgttaactacctgatcaacaggcggatttaagtacaactaatatcacacaaatgtccaattaaaaaatcatctcataatctatatggtccataacaaaagttgataacaacaaagttattaagcacctgaatatacttttgtaaaaggttagctagaaaaagacaat

SEQ ID NO: 663 - DNA, 200 bp, Conyza canadensis
attgtctttttctagctaaccttttacaaaagtatattcaggtgcttaataactttgttgttatcaacttttgttatggaccatatagattatgagatgattttttaattggacatttgtgtgatattagttgtacttaaatccgcctgttgatcaggtagttaacgatttaaataaaaagtttgagataaatcacatta

SEQ ID NO: 664 - DNA, 200 bp, Conyza canadensis
aaaaggttagctagaaaaagacaatatatatcataccatcagacttctacttgtggaaataacgttaccaagcacatatttccatatgaattacaacatgctaacctatattaaattacgtctatgatcattaacccaactcgatttggtattgtgatgtggtgattataacttacaacaaagtacaatatgataaaact

SEQ ID NO: 665 - DNA, 200 bp, Conyza canadensis
agttttatcatattgtactttgttgtaagttataatcaccacatcacaataccaaatcgagttgggttaatgatcatagacgtaatttaatataggttagcatgttgtaattcatatggaaatatgtgcttggtaacgttatttccacaagtagaagtctgatggtatgatatatattgtctttttctagctaacctttt

SEQ ID NO: 666 - DNA, 200 bp, Conyza canadensis
caacaaagtacaatatgataaaacttgctttttttatattattattatatccaaagtctctatattaatcatatttaaaaaagctattgacaaatcataacaaacaacacatttaagttccatatatactatccatgaatcaatcaatgaatccaaaattttattttcatgatgataaaaaggaaaataagaagaaaaaa

SEQ ID NO: 667 - DNA, 200 bp, Conyza canadensis
ttttttcttcttattttcctttttatcatcatgaaaataaaattttggattcattgattgattcatggatagtatatatggaacttaaatgtgttgtttgttatgatttgtcaatagcttttttaaatatgattaatatagagactttggatataataataatataaaaaaagcaagttttatcatattgtactttgttg

SEQ ID NO: 668 - DNA, 200 bp, Conyza canadensis
taaaaaggaaaataagaagaaaaaaaaaatagtttgaggttgtgagaaaaagccttatctagtttctcatcatatatgttgagttgaggcaaggaatgaaagggagaggggggcttttgttttgttatgatgaccttaaaaagagaccaaaaaccaatttcctccacccacacccctatctctttaggaaaggccaatct

SEQ ID NO: 669 - DNA, 200 bp, Conyza canadensis
agattggcctttcctaaagagataggggtgtgggtggaggaaattggtttttggtctctttttaaggtcatcataacaaaacaaaagcccccctctccctttcattccttgcctcaactcaacatatatgatgagaaactagataaggctttttctcacaacctcaaactattttttttttcttcttattttccttttta

SEQ ID NO: 670 - DNA, 200 bp, Conyza canadensis
ctatctctttaggaaaggccaatctcccctcctttgttttctccttttattttttatatatactttttattaaaataaaacatatactatttatttatttttacatccatttatcaaacaaacttgcaactttcttcttttcattcattttgccgctctcaaccatcacttttctctactttccggccggtacgttcctc

SEQ ID NO: 671 - DNA, 200 bp, Conyza canadensis
gaggaacgtaccggccggaaagtagagaaaagtgatggttgagagcggcaaaatgaatgaaaagaagaaagttgcaagtttgtttgataaatggatgtaaaaataaataaatagtatatgttttattttaataaaaagtatatataaaaaataaaaggagaaaacaaaggaggggagattggcctttcctaaagagatag

SEQ ID NO: 672 - DNA, 200 bp, Conyza canadensis
ctactttccggccggtacgttcctccctccctccctacattacgtcattgttttactcatcactatttacacacaaacatatgacttaatgtatacatataattttgtacggaacttttgcgatttatcagccgcacactcgaactaaattttttgatcggaaatgtagccattatatatatatatacacacagagagag

SEQ ID NO: 673 - DNA, 200 bp, Conyza canadensis
ctctctctgtgtgtatatatatatataatggctacatttccgatcaaaaaatttagttcgagtgtgcggctgataaatcgcaaaagttccgtacaaaattatatgtatacattaagtcatatgtttgtgtgtaaatagtgatgagtaaaacaatgacgtaatgtagggagggagggaggaacgtaccggccggaaagtag

SEQ ID NO: 674 - DNA, 200 bp, Conyza canadensis
tatatatatatacacacagagagagtatattaaatatatatatatatacacagagagatatcaaatatatgcatagcatatatatgcgtgtgtgtgtgtatgtatatataactttgctagtgttaattactcgaaatgacgatgtataacaagtagtagtaaatcagtagaaacggcgtcgtcctattagtgtatgatgg

SEQ ID NO: 675 - DNA, 200 bp, Conyza canadensis
ccatcatacactaataggacgacgccgtttctactgatttactactacttgttatacatcgtcatttcgagtaattaacactagcaaagttatatatacatacacacacacacgcatatatatgctatgcatatatttgatatctctctgtgtatatatatatatatttaatatactctctctgtgtgtatatatatata

SEQ ID NO: 676 - DNA, 200 bp, Conyza canadensis
gcgtcgtcctattagtgtatgatggcaactacaagtagtaaatcaagcctaaaagtttgttcaatattaaaaattaaaataaaaaccaggcctgaaaatgtggaagggttgttagtggttaaattagttgacctggatggaggtaggtcagatgataatagtagctgttgatccaggccaagtggaggatcaccacacac

SEQ ID NO: 677 - DNA, 200 bp, Conyza canadensis
gtgtgtggtgatcctccacttggcctggatcaacagctactattatcatctgacctacctccatccaggtcaactaatttaaccactaacaacccttccacattttcaggcctggtttttattttaatttttaatattgaacaaacttttaggcttgatttactacttgtagttgccatcatacactaataggacgacgc

SEQ ID NO: 678 - DNA, 200 bp, Conyza canadensis
ggccaagtggaggatcaccacacacttgtatctactcttgattattttattatttttaaactgctacttttgattaatcattaatttcatatgaacattttaatataaacatttttgcatctgaaaatgtttttccatctgctaaggatgaaaggaccaaaatgcccttccatgctgttcaatgtttttcataatttaaa

SEQ ID NO: 679 - DNA, 200 bp, Conyza canadensis
tttaaattatgaaaaacattgaacagcatggaagggcattttggtcctttcatccttagcagatggaaaaacattttcagatgcaaaaatgtttatattaaaatgttcatatgaaattaatgattaatcaaaagtagcagtttaaaaataataaaataatcaagagtagatacaagtgtgtggtgatcctccacttggcc

SEQ ID NO: 680 - DNA, 200 bp, Conyza canadensis
tgttcaatgtttttcataatttaaaaggttatatatatatttactaatctagctagtgattatatatgttgccttttgaatctgatgatctttttttggccagctacttgaatattgttaaataaatttagaaaaataaatatatgaatgataagttttaacttttaggtaaaaggatcttgataagcaatagctgaaag

SEQ ID NO: 681 - DNA, 200 bp, Conyza canadensis
ctttcagctattgcttatcaagatccttttacctaaaagttaaaacttatcattcatatatttatttttctaaatttatttaacaatattcaagtagctggccaaaaaaagatcatcagattcaaaaggcaacatatataatcactagctagattagtaaatatatatataaccttttaaattatgaaaaacattgaaca

SEQ ID NO: 682 - DNA, 200 bp, Conyza canadensis
gatcttgataagcaatagctgaaagtccggagctagaaagggcttggtattggtgggacgtaattgaaaagatatacaaaattaaacatttatgatttttgcatctgtttgtatttagtgtgtcgaatgaaaagtaaatgtataaagagttgtgataaatttttggatccgaactggtacagtggtacattacagacacg

SEQ ID NO: 683 - DNA, 200 bp, Conyza canadensis
cgtgtctgtaatgtaccactgtaccagttcggatccaaaaatttatcacaactctttatacatttacttttcattcgacacactaaatacaaacagatgcaaaaatcataaatgtttaattttgtatatcttttcaattacgtcccaccaataccaagccctttctagctccggactttcagctattgcttatcaagatc

SEQ ID NO: 684 - DNA, 200 bp, Conyza canadensis
ggtacagtggtacattacagacacgggcgaaagcttggagtgttactttgatcctagatcttaatagacgagattcgttacatattaactaataatagaaatgcagcaatgccccccttgtttatattaaagattcatttttctcatgtgtgaattatgattttttgataagacaaaagttgtttacttgaagttgaatg

SEQ ID NO: 685 - DNA, 200 bp, Conyza canadensis
cattcaacttcaagtaaacaacttttgtcttatcaaaaaatcataattcacacatgagaaaaatgaatctttaatataaacaaggggggcattgctgcatttctattattagttaatatgtaacgaatctcgtctattaagatctaggatcaaagtaacactccaagctttcgcccgtgtctgtaatgtaccactgtacc

SEQ ID NO: 686 - DNA, 200 bp, Conyza canadensis
aaagttgtttacttgaagttgaatgatgtgggttcctacttgttttaaaaatgtgtaacctcttatctaaaaactctgtacttacgatgatcacaagaacctgcattgctgaccatttatcttatttattgatatttttgtgtctgataatatgggtaggtgaaaatggcacaatgtttggctccttcagtacaatggca

SEQ ID NO: 687 - DNA, 200 bp, Conyza canadensis
tgccattgtactgaaggagccaaacattgtgccattttcacctacccatattatcagacacaaaaatatcaataaataagataaatggtcagcaatgcaggttcttgtgatcatcgtaagtacagagtttttagataagaggttacacatttttaaaacaagtaggaacccacatcattcaacttcaagtaaacaacttt

SEQ ID NO: 688 - DNA, 200 bp, Conyza canadensis
gtttggctccttcagtacaatggcagatgaggttaacaaaaaatggtatggaatcaagctctatgtcatccaaaatgtggaactctttgtccttgaagcaaagcaagaaaggagcacttaagaacgccacaaaattcagcatctgtgcttcagcaaatggaaccattaacaggatggaagacctactaaacttggatgtc

SEQ ID NO: 689 - DNA, 200 bp, Conyza canadensis
gacatccaagtttagtaggtcttccatcctgttaatggttccatttgctgaagcacagatgctgaattttgtggcgttcttaagtgctcctttcttgctttgcttcaaggacaaagagttccacattttggatgacatagagcttgattccataccattttttgttaacctcatctgccattgtactgaaggagccaaac

SEQ ID NO: 690 - DNA, 200 bp, Conyza canadensis
ggaagacctactaaacttggatgtcactccttacaccaataagatcattgctgaatacatttggtatatttcattctttggatacacttaccatacaaatttcaggcttactaacatattaacaaaagtttgttacgttactctaaaggcttgttcaattcttatttagtcctatgctttctactttctgaaacaggatt

SEQ ID NO: 691 - DNA, 200 bp, Conyza canadensis
aatcctgtttcagaaagtagaaagcataggactaaataagaattgaacaagcctttagagtaacgtaacaaacttttgttaatatgttagtaagcctgaaatttgtatggtaagtgtatccaaagaatgaaatataccaaatgtattcagcaatgatcttattggtgtaaggagtgacatccaagtttagtaggtcttcc

SEQ ID NO: 692 - DNA, 200 bp, Conyza canadensis
gctttctactttctgaaacaggattggaggttctgggacagatgtgcgcagcaaatcaagggtatgttgggttttgatgctttggtttctttcagtaattatctatagcttcgctaaaaggaaagattgtaatatatgtttcattatatctcttgtagacactctcaaaaccagttgagcatccttctgagcttccaaaa

SEQ ID NO: 693 - DNA, 200 bp, Conyza canadensis
ttttggaagctcagaaggatgctcaactggttttgagagtgtctacaagagatataatgaaacatatattacaatctttccttttagcgaagctatagataattactgaaagaaaccaaagcatcaaaacccaacatacccttgatttgctgcgcacatctgtcccagaacctccaatcctgtttcagaaagtagaaagc

SEQ ID NO: 694 - DNA, 200 bp, Conyza canadensis
tgagcatccttctgagcttccaaaatggaactatgatggatcaagtactggacaagctccaggagaagatagtgaagttatcttatagtaagttttatttcaaaaaatcacaagtctctttacatgtggtgatgtaaccaaagttgaaattctgtatttcagcccccaggcaatctttaaggatcctttccgtggtggca

SEQ ID NO: 695 - DNA, 200 bp, Conyza canadensis
tgccaccacggaaaggatccttaaagattgcctgggggctgaaatacagaatttcaactttggttacatcaccacatgtaaagagacttgtgattttttgaaataaaacttactataagataacttcactatcttctcctggagcttgtccagtacttgatccatcatagttccattttggaagctcagaaggatgctca

SEQ ID NO: 696 - DNA, 200 bp, Conyza canadensis
tttaaggatcctttccgtggtggcaacaacatcttggtgagtataacgttggttcattatactataaagtcttatgtataagctgagaaactcccaccaaccaaaaggttgcagtttcgagttctatatggacaagtgcatgcgaattttttccccttgaaaaataaggatacaaactgaaattggacaacatatggctt

SEQ ID NO: 697 - DNA, 200 bp, Conyza canadensis
aagccatatgttgtccaatttcagtttgtatccttatttttcaaggggaaaaaattcgcatgcacttgtccatatagaactcgaaactgcaaccttttggttggtgggagtttctcagcttatacataagactttatagtataatgaaccaacgttatactcaccaagatgttgttgccaccacggaaaggatccttaaa

SEQ ID NO: 698 - DNA, 200 bp, Conyza canadensis
actgaaattggacaacatatggcttaaactgattctgtactgtttttataggtgatctgtgacgcatacactccgcaaggcgagcctatccctactaacaaacgtgctaaggctgctgagattttcagtaatcctaaagttgtatcgcaagtgccctggtaggctttttgggtgaaaatgttcttttttttcccccatag

SEQ ID NO: 699 - DNA, 200 bp, Conyza canadensis
ctatgggggaaaaaaaagaacattttcacccaaaaagcctaccagggcacttgcgatacaactttaggattactgaaaatctcagcagccttagcacgtttgttagtagggataggctcgccttgcggagtgtatgcgtcacagatcacctataaaaacagtacagaatcagtttaagccatatgttgtccaatttcagt

SEQ ID NO: 700 - DNA, 200 bp, Conyza canadensis
aaatgttcttttttttcccccatagaactaaactcttaaatccctgtgtttgataattgatacatacattaaacttcttgtcacatgaataaggggcagataggtctgactttattagtcaacatacacctcccttttatgtgaacggggatactctactaaaacaacaaaataaacaaatattgcctctgtttatttcc

SEQ ID NO: 701 - DNA, 200 bp, Conyza canadensis
ggaaataaacagaggcaatatttgtttattttgttgttttagtagagtatccccgttcacataaaagggaggtgtatgttgactaataaagtcagacctatctgccccttattcatgtgacaagaagtttaatgtatgtatcaattatcaaacacagggatttaagagtttagttctatgggggaaaaaaaagaacattt

SEQ ID NO: 702 - DNA, 200 bp, Conyza canadensis
acaaatattgcctctgtttatttcccggtaaaattgattttaaatttggttttaggtttggaattgagcaagagtacactttgcttcagacagatgtgaagtggcctttgggttggcctgttggaggctaccctggtcctcaggtactattcatgatctaacttttgtaaacttctacaccttcctcatttataaatggg

SEQ ID NO: 703 - DNA, 200 bp, Conyza canadensis
cccatttataaatgaggaaggtgtagaagtttacaaaagttagatcatgaatagtacctgaggaccagggtagcctccaacaggccaacccaaaggccacttcacatctgtctgaagcaaagtgtactcttgctcaattccaaacctaaaaccaaatttaaaatcaattttaccgggaaataaacagaggcaatatttgt

SEQ ID NO: 704 - DNA, 200 bp, Conyza canadensis
tacaccttcctcatttataaatgggatttaatatcagttaaagctaaaggtggcaaaatgagtgggctagattgacctgaaagacttttttttaaactaattttttagttttccctatttataattagtgtgccaaatattgttataatcatttaatttcaaaaatagtttatctttttttgagtaaccattatactaaa

SEQ ID NO: 705 - DNA, 200 bp, Conyza canadensis
tttagtataatggttactcaaaaaaagataaactatttttgaaattaaatgattataacaatatttggcacactaattataaatagggaaaactaaaaaattagtttaaaaaaaagtctttcaggtcaatctagcccactcattttgccacctttagctttaactgatattaaatcccatttataaatgaggaaggtgta

SEQ ID NO: 706 - DNA, 200 bp, Conyza canadensis
ttttttgagtaaccattatactaaattcactcgtttgaaccattagagataaagcataactgaagagcgattctttcataagcaatgaatgaaattttccacccttaaaaacaagtgttcttattaaatgtatttccttttgaaactacagggtccatactactgtggtgctggagctgataagtcgtttggaagagaca

SEQ ID NO: 707 - DNA, 200 bp, Conyza canadensis
tgtctcttccaaacgacttatcagctccagcaccacagtagtatggaccctgtagtttcaaaaggaaatacatttaataagaacacttgtttttaagggtggaaaatttcattcattgcttatgaaagaatcgctcttcagttatgctttatctctaatggttcaaacgagtgaatttagtataatggttactcaaaaaa

SEQ ID NO: 708 - DNA, 200 bp, Conyza canadensis
gctgataagtcgtttggaagagacatatcggatgcacattacaaggcctgcctgtatgccggaattaacatcagtgggaccaatggagaagttatgcctggacaggttttttttctacttcttcaccttattatctaatgaattatgaaaagaagtatcatggcaacaattgtgtttcacagtgggaatttcaagttggt

SEQ ID NO: 709 - DNA, 200 bp, Conyza canadensis
accaacttgaaattcccactgtgaaacacaattgttgccatgatacttcttttcataattcattagataataaggtgaagaagtagaaaaaaaacctgtccaggcataacttctccattggtcccactgatgttaattccggcatacaggcaggccttgtaatgtgcatccgatatgtctcttccaaacgacttatcagc

SEQ ID NO: 710 - DNA, 200 bp, Conyza canadensis
ttcacagtgggaatttcaagttggtcctagtgtgggaattgaagctggagaccatatctggtgtgctagatacctccttgaggtaaatcatcttcagcaatttgatacagtaacaacttaatatatcctaccgtgtttttttaatctatatctaattgtttcttgtgactttactgtatttaacagagaattactgaaca

SEQ ID NO: 711 - DNA, 200 bp, Conyza canadensis
tgttcagtaattctctgttaaatacagtaaagtcacaagaaacaattagatatagattaaaaaaacacggtaggatatattaagttgttactgtatcaaattgctgaagatgatttacctcaaggaggtatctagcacaccagatatggtctccagcttcaattcccacactaggaccaacttgaaattcccactgtgaa

SEQ ID NO: 712 - DNA, 200 bp, Conyza canadensis
gtatttaacagagaattactgaacaagctggtgtcgtgttgacccttgaccctaagcctattgatgtaagatatatcttgtttgatgactactttccttcaattttccatcatagtgttcaaatcttgcttagggagaacatttgagcaacatgtaatgtcactcttttgtaattagaggtggttagataggcatgttgg

SEQ ID NO: 713 - DNA, 200 bp, Conyza canadensis
ccaacatgcctatctaaccacctctaattacaaaagagtgacattacatgttgctcaaatgttctccctaagcaagatttgaacactatgatggaaaattgaaggaaagtagtcatcaaacaagatatatcttacatcaataggcttagggtcaagggtcaacacgacaccagcttgttcagtaattctctgttaaatac

SEQ ID NO: 714 - DNA, 200 bp, Conyza canadensis
agaggtggttagataggcatgttggttaatgtgtccaaatgtacaattctttgatgacacaagcttagttgaccataaacacttttttccttttgtttttcttacaaaaaagacgaacaagataattggcaattcaagctatattaaaattcaaaaatttaaactttttgagtaaaaaggaatttcaggaggtgttatga

SEQ ID NO: 715 - DNA, 200 bp, Conyza canadensis
tcataacacctcctgaaattcctttttactcaaaaagtttaaatttttgaattttaatatagcttgaattgccaattatcttgttcgtcttttttgtaagaaaaacaaaaggaaaaaagtgtttatggtcaactaagcttgtgtcatcaaagaattgtacatttggacacattaaccaacatgcctatctaaccacctct

SEQ ID NO: 716 - DNA, 200 bp, Conyza canadensis
aaaggaatttcaggaggtgttatgagctaataaaagtatacattttaggtcactcatttgtgtcgatttcattttaagctacttctattgggtttaacaatgggaggcacagaaaacgcctcagttgaccctttgataactaaacgggttgaatttgccacctctacccgctctgaatgattctgattttattcttaact

SEQ ID NO: 717 - DNA, 200 bp, Conyza canadensis
agttaagaataaaatcagaatcattcagagcgggtagaggtggcaaattcaacccgtttagttatcaaagggtcaactgaggcgttttctgtgcctcccattgttaaacccaatagaagtagcttaaaatgaaatcgacacaaatgagtgacctaaaatgtatacttttattagctcataacacctcctgaaattccttt

SEQ ID NO: 718 - DNA, 200 bp, Conyza canadensis
aatgattctgattttattcttaacttacacaacgcttgttgatttgaattggcagggagactggaatggagcaggatgccacactaactacaggtacttgttttctttactcataatagacctgcgtattgtttttgaaacgctctaatgtgtgtgaacgttgatttctttcttatattaaaaatccattcacttacttt

SEQ ID NO: 719 - DNA, 200 bp, Conyza canadensis
aaagtaagtgaatggatttttaatataagaaagaaatcaacgttcacacacattagagcgtttcaaaaacaatacgcaggtctattatgagtaaagaaaacaagtacctgtagttagtgtggcatcctgctccattccagtctccctgccaattcaaatcaacaagcgttgtgtaagttaagaataaaatcagaatcatt

SEQ ID NO: 720 - DNA, 200 bp, Conyza canadensis
tattaaaaatccattcacttacttttgtgctttcaaatttcagtacattggccatgagagaagaaggtgggtttgaagtaattaaaaaggcgattctgaacttgtcacttcgccacactgagcacatcagtgcttatggagaaggcaatgagagaagattgacagggaagcacgaaactgccagcattaaccagttttca

SEQ ID NO: 721 - DNA, 200 bp, Conyza canadensis
tgaaaactggttaatgctggcagtttcgtgcttccctgtcaatcttctctcattgccttctccataagcactgatgtgctcagtgtggcgaagtgacaagttcagaatcgcctttttaattacttcaaacccaccttcttctctcatggccaatgtactgaaatttgaaagcacaaaagtaagtgaatggatttttaata

SEQ ID NO: 722 - DNA, 200 bp, Conyza canadensis
aactgccagcattaaccagttttcatgggtataaaacattttatatcgaattataagagataaaccaaaaaaaataatttacactttcataagctttctcaactgatggtttttgtattcggtgaacttgcagggtgtagcaaatcgtggttgctcaatccgtgtggggcgtgacactgagagggaaggcaaaggtattg

SEQ ID NO: 723 - DNA, 200 bp, Conyza canadensis
caatacctttgccttccctctcagtgtcacgccccacacggattgagcaaccacgatttgctacaccctgcaagttcaccgaatacaaaaaccatcagttgagaaagcttatgaaagtgtaaattattttttttggtttatctcttataattcgatataaaatgttttatacccatgaaaactggttaatgctggcagtt

SEQ ID NO: 724 - DNA, 200 bp, Conyza canadensis
actgagagggaaggcaaaggtattgctatcttcacactacagtctttatcattggtggataattggatattggtaactcgtcaaactgggtaaatatatgttatggttcaacgtgttgggatgaccaaataaacattttatataattatcaaaatcttcataaacatattgttaatataccaaacatgtttccagaaatt

SEQ ID NO: 725 - DNA, 200 bp, Conyza canadensis
aatttctggaaacatgtttggtatattaacaatatgtttatgaagattttgataattatataaaatgtttatttggtcatcccaacacgttgaaccataacatatatttacccagtttgacgagttaccaatatccaattatccaccaatgataaagactgtagtgtgaagatagcaatacctttgccttccctctcagt

SEQ ID NO: 726 - DNA, 200 bp, Conyza canadensis
tataccaaacatgtttccagaaattataaaatttcaacagtaatctgccttcttgaattaatcgatttaggaggtgtaatgcattagaatcacaaatcgccaactgattttatttttattttttctttctgaaataacctaaattgaccgttcattagtgagtctaaatttccacctttaaaaaaattctctttcgaaat

SEQ ID NO: 727 - DNA, 200 bp, Conyza canadensis
atttcgaaagagaatttttttaaaggtggaaatttagactcactaatgaacggtcaatttaggttatttcagaaagaaaaaataaaaataaaatcagttggcgatttgtgattctaatgcattacacctcctaaatcgattaattcaagaaggcagattactgttgaaattttataatttctggaaacatgtttggtata

SEQ ID NO: 728 - DNA, 200 bp, Conyza canadensis
ctttaaaaaaattctctttcgaaatctgttttttcacgggtcatgtttactatgtgcaggttatttggaagacagacgcccggcatcaaacatggacccgtacaccgtgaccggattactcgccgaaacaaccatcctttgggagcctacccttgaggctgaagcacttgctgcccagaagttggcattgaatgtgtaag

SEQ ID NO: 729 - DNA, 200 bp, Conyza canadensis
cttacacattcaatgccaacttctgggcagcaagtgcttcagcctcaagggtaggctcccaaaggatggttgtttcggcgagtaatccggtcacggtgtacgggtccatgtttgatgccgggcgtctgtcttccaaataacctgcacatagtaaacatgacccgtgaaaaaacagatttcgaaagagaatttttttaaag

SEQ ID NO: 730 - DNA, 200 bp, Conyza canadensis
cagaagttggcattgaatgtgtaagactctcccacgaggtgatatacaacgaagaaagtgtcaacatgcatattcatccatgttcttcgtaaactcggtttcctgtttctagttgatttcttgaagatcttgtaaataaaggtcatcactgcttcaaattcaagctatttttagcaaatgggtgtttttcagatgattat

SEQ ID NO: 731 - DNA, 200 bp, Conyza canadensis
ataatcatctgaaaaacacccatttgctaaaaatagcttgaatttgaagcagtgatgacctttatttacaagatcttcaagaaatcaactagaaacaggaaaccgagtttacgaagaacatggatgaatatgcatgttgacactttcttcgttgtatatcacctcgtgggagagtcttacacattcaatgccaacttctg

SEQ ID NO: 732 - DNA, 200 bp, Conyza canadensis
aaatgggtgtttttcagatgattattggacagtttatgcacaatttgaagtgtgcacaagtgcacttgacccggtctgagcagacattattttctcttcttgatttaaagaaagcaccctcacattttgggggtattttctcttcatttgatcatatcatataattatcaatcggtttagatgggctgctgctccttttt

SEQ ID NO: 733 - DNA, 200 bp, Conyza canadensis
aaaaaggagcagcagcccatctaaaccgattgataattatatgatatgatcaaatgaagagaaaatacccccaaaatgtgagggtgctttctttaaatcaagaagagaaaataatgtctgctcagaccgggtcaagtgcacttgtgcacacttcaaattgtgcataaactgtccaataatcatctgaaaaacacccattt

SEQ ID NO: 734 - DNA, 200 bp, Conyza canadensis
tttagatgggctgctgctccttttttggtcaattttattactagattgcttgtcaatgctaattatttcgttaaaattggaaaatgatgtaattcatacttacaattcttactgcgaaaagggaggctaaataacagtagaacactagaacttcaacaacaacgagagttataatacaagagagttaaataagcatttat

SEQ ID NO: 735 - DNA, 200 bp, Conyza canadensis
ataaatgcttatttaactctcttgtattataactctcgttgttgttgaagttctagtgttctactgttatttagcctcccttttcgcagtaagaattgtaagtatgaattacatcattttccaattttaacgaaataattagcattgacaagcaatctagtaataaaattgaccaaaaaaggagcagcagcccatctaaa

SEQ ID NO: 736 - DNA, 200 bp, Conyza canadensis
acaagagagttaaataagcatttatataacttaactaagtaaaatatacaactatctcttttgccctccctgcttgaaaacaatggacttaatattgtggaatcacagtcaggaatctcaacgagttaaaaaaaatgacgatgatgtacgttaccattttttagttatacatcacaaacatgtgttctatcatacaatga

SEQ ID NO: 737 - DNA, 200 bp, Conyza canadensis
tcattgtatgatagaacacatgtttgtgatgtataactaaaaaatggtaacgtacatcatcgtcattttttttaactcgttgagattcctgactgtgattccacaatattaagtccattgttttcaagcagggagggcaaaagagatagttgtatattttacttagttaagttatataaatgcttatttaactctcttgt

SEQ ID NO: 738 - DNA, 200 bp, Conyza canadensis
aaacatgtgttctatcatacaatgatgtgaaacatgtatgtgttggtcaatggtcataataaaatcatatgcacgaaccgaccaactaggaaaggatggattgttcagaccttgatggattaagatcaaaacaaatgtctctacggtaatgttatcatctagtagctagtaattggttatagaaacaatcgttacacaaa

SEQ ID NO: 739 - DNA, 200 bp, Conyza canadensis
tttgtgtaacgattgtttctataaccaattactagctactagatgataacattaccgtagagacatttgttttgatcttaatccatcaaggtctgaacaatccatcctttcctagttggtcggttcgtgcatatgattttattatgaccattgaccaacacatacatgtttcacatcattgtatgatagaacacatgttt

SEQ ID NO: 740 - DNA, 200 bp, Conyza canadensis
gttatagaaacaatcgttacacaaatcatctactaaaattacaatagtaaaaaccatctttcaaccattgtcaaactaacaatgtattacacattcaaccggttactagtctatagatagtttttattattggttacatggtttgtagtttccataatgtaatcaaagttcgttattattttacctgattagtggtaccc

SEQ ID NO: 741 - DNA, 200 bp, Conyza canadensis
gggtaccactaatcaggtaaaataataacgaactttgattacattatggaaactacaaaccatgtaaccaataataaaaactatctatagactagtaaccggttgaatgtgtaatacattgttagtttgacaatggttgaaagatggtttttactattgtaattttagtagatgatttgtgtaacgattgtttctataac

SEQ ID NO: 742 - DNA, 200 bp, Conyza canadensis
ttattttacctgattagtggtacccatcatgtgaccacacgatcttacatataaaagttaaagcaagtggagaaatcatatatcttgtgatccatgtgtgagaataatgatttatcggatatgagtcttatgtggtgtgcgagctagataagaaaatagtatatatgttttatgaaatgatccgcggtttacaggaccaa

SEQ ID NO: 743 - DNA, 200 bp, Conyza canadensis
ttggtcctgtaaaccgcggatcatttcataaaacatatatactattttcttatctagctcgcacaccacataagactcatatccgataaatcattattctcacacatggatcacaagatatatgatttctccacttgctttaacttttatatgtaagatcgtgtggtcacatgatgggtaccactaatcaggtaaaataa

SEQ ID NO: 744 - DNA, 200 bp, Conyza canadensis
aatgatccgcggtttacaggaccaaagagttctagctcgttcacctttttatttaactttaggctgaagacattaaaaaaaaaaaaaggttataatactactttgacctccattgaaaccaaaactatttgtctttccaaacagtctcccaaatgtacacccaacttcttcaaactcacccaatcttcactttcaaaccc

SEQ ID NO: 745 - DNA, 200 bp, Conyza canadensis
gggtttgaaagtgaagattgggtgagtttgaagaagttgggtgtacatttgggagactgtttggaaagacaaatagttttggtttcaatggaggtcaaagtagtattataacctttttttttttttaatgtcttcagcctaaagttaaataaaaaggtgaacgagctagaactctttggtcctgtaaaccgcggatcatt

SEQ ID NO: 746 - DNA, 200 bp, Conyza canadensis
tcacccaatcttcactttcaaaccctgttcaatctcttccagccatccccttatcttcatcaacaccagtcaccaatttcccataaaccaaagacccccaaattcatcctttcattacaatcacaaaaccctgttcaaaactctcataaactgtactcaaaatgccgattctaatacaccaaaatgggaaaacttgttgc

SEQ ID NO: 747 - DNA, 200 bp, Conyza canadensis
gcaacaagttttcccattttggtgtattagaatcggcattttgagtacagtttatgagagttttgaacagggttttgtgattgtaatgaaaggatgaatttgggggtctttggtttatgggaaattggtgactggtgttgatgaagataaggggatggctggaagagattgaacagggtttgaaagtgaagattgggtga

SEQ ID NO: 748 - DNA, 200 bp, Conyza canadensis
acaccaaaatgggaaaacttgttgccaaagaatgtaatctctgctgagaaaatattgaggtcaattgctggggcaacttctagtcctatttgtcagttcatctcttcacctactactttcttgcactctgttgaccccaggattaaattggtaaagtttgttgcttttttgaaaattcttgttattggtttttgggtttt

SEQ ID NO: 749 - DNA, 200 bp, Conyza canadensis
aaaacccaaaaaccaataacaagaattttcaaaaaagcaacaaactttaccaatttaatcctggggtcaacagagtgcaagaaagtagtaggtgaagagatgaactgacaaataggactagaagttgccccagcaattgacctcaatattttctcagcagagattacattctttggcaacaagttttcccattttggtgt

SEQ ID NO: 750 - DNA, 200 bp, Conyza canadensis
ttcttgttattggtttttgggttttttctttattgataattttaagtctttaaccatattgtgatgtgatttaccttcttctttcatgttgagtgttgggctggtcagggggaatgggtcagttacccatttattctgatggtgtgcttttatgatttaagttgataaattccatgactttttaggggattcttgcaatt

SEQ ID NO: 751 - DNA, 200 bp, Conyza canadensis
aattgcaagaatcccctaaaaagtcatggaatttatcaacttaaatcataaaagcacaccatcagaataaatgggtaactgacccattccccctgaccagcccaacactcaacatgaaagaagaaggtaaatcacatcacaatatggttaaagacttaaaattatcaataaagaaaaaacccaaaaaccaataacaagaa

SEQ ID NO: 752 - DNA, 200 bp, Conyza canadensis
gactttttaggggattcttgcaattcttcctgggtattgctttattgggtattttgtaaattggtttatatgctttagtatgtgttagttcaatttgttcattgttgttgaaaatatgttgtgaaacatagccatggctttgatggtcgtgcttttttgtataaaaagttgtttttatctttatgtaagaaaagatagag

SEQ ID NO: 753 - DNA, 200 bp, Conyza canadensis
ctctatcttttcttacataaagataaaaacaactttttatacaaaaaagcacgaccatcaaagccatggctatgtttcacaacatattttcaacaacaatgaacaaattgaactaacacatactaaagcatataaaccaatttacaaaatacccaataaagcaatacccaggaagaattgcaagaatcccctaaaaagtc

SEQ ID NO: 754 - DNA, 200 bp, Conyza canadensis
tatctttatgtaagaaaagatagagtgtcactagtagtctctgtgatggtagcttagttgccgggaaagttaagtttaatgcactttaggtggtgcggagttcacgctcttgcatttttttttatttttattttttgcattgtcttgcagtagaatttgcttatccttagggacctgattgggttgaaatactacttaag

SEQ ID NO: 755 - DNA, 200 bp, Conyza canadensis
cttaagtagtatttcaacccaatcaggtccctaaggataagcaaattctactgcaagacaatgcaaaaaataaaaataaaaaaaaatgcaagagcgtgaactccgcaccacctaaagtgcattaaacttaactttcccggcaactaagctaccatcacagagactactagtgacactctatcttttcttacataaagata

SEQ ID NO: 756 - DNA, 200 bp, Conyza canadensis
aaagatggggcttgaaaaggttcaaaattttagacctttccaaaattagataatttattatttttttctttttaagaattaagacatttaatttatttagaaagctataagtgttgaatcatcatgaaaattggcttataaaaatatgttaatattaatattatgaaccttcagaaagattttatgccataaatattttt

SEQ ID NO: 757 - DNA, 200 bp, Conyza canadensis
aaaaatatttatggcataaaatctttctgaaggttcataatattaatattaacatatttttataagccaattttcatgatgattcaacacttatagctttctaaataaattaaatgtcttaattcttaaaaagaaaaaaataataaattatctaattttggaaaggtctaaaattttgaaccttttcaagccccatcttt

SEQ ID NO: 758 - DNA, 200 bp, Conyza canadensis
aagattttatgccataaatattttttatgtatgatgactgatgatattgtgtaaatatcatagattgaagaccctttcaaactttaaaaacggtgttgatatcatcactatttagaaaaagaactcttttttttttaatgtgatttatctcaaactttttatttaaatcgttaactacctgatcaacaggcggatttaag

SEQ ID NO: 759 - DNA, 200 bp, Conyza canadensis
cttaaatccgcctgttgatcaggtagttaacgatttaaataaaaagtttgagataaatcacattaaaaaaaaaagagttctttttctaaatagtgatgatatcaacaccgtttttaaagtttgaaagggtcttcaatctatgatatttacacaatatcatcagtcatcatacataaaaaatatttatggcataaaatctt

SEQ ID NO: 760 - DNA, 200 bp, Conyza canadensis
tacctgatcaacaggcggatttaagtacaactaatatcacacaaatgtccaattaaaaaatcatctcataatctatatggtccataacaaaagttgataacaacaaagttattaagcacctgaatatacttttgtaaaaggttagctagaaaaagacaatatatatcataccatcagacttctacttgtggaaataacgt

SEQ ID NO: 761 - DNA, 200 bp, Conyza canadensis
acgttatttccacaagtagaagtctgatggtatgatatatattgtctttttctagctaaccttttacaaaagtatattcaggtgcttaataactttgttgttatcaacttttgttatggaccatatagattatgagatgattttttaattggacatttgtgtgatattagttgtacttaaatccgcctgttgatcaggta

SEQ ID NO: 762 - DNA, 200 bp, Conyza canadensis
agacttctacttgtggaaataacgttaccaagcacatatttccatatgaattacaacatgctaacctatattaaattacgtctatgatcattaacccaactcgatttggtattgtgatgtggtgattataacttacaacaaagtacaatatgataaaacttgctttttttatattattattatatccaaagtctctatat

SEQ ID NO: 763 - DNA, 200 bp, Conyza canadensis
atatagagactttggatataataataatataaaaaaagcaagttttatcatattgtactttgttgtaagttataatcaccacatcacaataccaaatcgagttgggttaatgatcatagacgtaatttaatataggttagcatgttgtaattcatatggaaatatgtgcttggtaacgttatttccacaagtagaagtct

SEQ ID NO: 764 - DNA, 200 bp, Conyza canadensis
attattatatccaaagtctctatattaatcatatttaaaaaagctattgacaaatcataacaaacaacacatttaagttccatatatactatccatgaatcaatcaatgaatccaaaattttattttcatgatgataaaaaggaaaataagaagaaaaaaaaaatagtttgaggttgtgagaaaaagccttatctagttt

SEQ ID NO: 765 - DNA, 200 bp, Conyza canadensis
aaactagataaggctttttctcacaacctcaaactattttttttttcttcttattttcctttttatcatcatgaaaataaaattttggattcattgattgattcatggatagtatatatggaacttaaatgtgttgtttgttatgatttgtcaatagcttttttaaatatgattaatatagagactttggatataataat

SEQ ID NO: 766 - DNA, 200 bp, Conyza canadensis
tgtgagaaaaagccttatctagtttctcatcatatatgttgagttgaggcaaggaatgaaagggagaggggggcttttgttttgttatgatgaccttaaaaagagaccaaaaaccaatttcctccacccacacccctatctctttaggaaaggccaatctcccctcctttgttttctccttttattttttatatatactt

SEQ ID NO: 767 - DNA, 200 bp, Conyza canadensis
aagtatatataaaaaataaaaggagaaaacaaaggaggggagattggcctttcctaaagagataggggtgtgggtggaggaaattggtttttggtctctttttaaggtcatcataacaaaacaaaagcccccctctccctttcattccttgcctcaactcaacatatatgatgagaaactagataaggctttttctcaca

SEQ ID NO: 768 - DNA, 200 bp, Conyza canadensis
ctccttttattttttatatatactttttattaaaataaaacatatactatttatttatttttacatccatttatcaaacaaacttgcaactttcttcttttcattcattttgccgctctcaaccatcacttttctctactttccggccggtacgttcctccctccctccctacattacgtcattgttttactcatcacta

SEQ ID NO: 769 - DNA, 200 bp, Conyza canadensis
tagtgatgagtaaaacaatgacgtaatgtagggagggagggaggaacgtaccggccggaaagtagagaaaagtgatggttgagagcggcaaaatgaatgaaaagaagaaagttgcaagtttgtttgataaatggatgtaaaaataaataaatagtatatgttttattttaataaaaagtatatataaaaaataaaaggag

SEQ ID NO: 770 - DNA, 200 bp, Conyza canadensis
tacgtcattgttttactcatcactatttacacacaaacatatgacttaatgtatacatataattttgtacggaacttttgcgatttatcagccgcacactcgaactaaattttttgatcggaaatgtagccattatatatatatatacacacagagagagatattaaatatatatatatatacacagagagatatcaaat

SEQ ID NO: 771 - DNA, 200 bp, Conyza canadensis
atttgatatctctctgtgtatatatatatatatttaatatctctctctgtgtgtatatatatatataatggctacatttccgatcaaaaaatttagttcgagtgtgcggctgataaatcgcaaaagttccgtacaaaattatatgtatacattaagtcatatgtttgtgtgtaaatagtgatgagtaaaacaatgacgta

SEQ ID NO: 772 - DNA, 200 bp, Conyza canadensis
atatatacacagagagatatcaaatatatgcatagcatatatatgcgtgtgtgtgtgtatgtatatataactttgctagtgttaattactcgaaatgacgatgtataacaagtagtagtaaatcagtagaaacggcgtcgtcctattagtgtatgatggcaactacaagtagtaaatcaagcctaaaagtttgttcaata

SEQ ID NO: 773 - DNA, 200 bp, Conyza canadensis
tattgaacaaacttttaggcttgatttactacttgtagttgccatcatacactaataggacgacgccgtttctactgatttactactacttgttatacatcgtcatttcgagtaattaacactagcaaagttatatatacatacacacacacacgcatatatatgctatgcatatatttgatatctctctgtgtatatat

SEQ ID NO: 774 - DNA, 200 bp, Conyza canadensis
atcaagcctaaaagtttgttcaatattaaaaattaaaataaaaaccaggcctgaaaatgtggaagggttgttagtggttaaattagttgacctggatggaggtaggtcagatgataatagtagctgttgatccaggccaagtggaggatcaccacacacttgtatctactcttgattattttattatttttaaactgcta

SEQ ID NO: 775 - DNA, 200 bp, Conyza canadensis
tagcagtttaaaaataataaaataatcaagagtagatacaagtgtgtggtgatcctccacttggcctggatcaacagctactattatcatctgacctacctccatccaggtcaactaatttaaccactaacaacccttccacattttcaggcctggtttttattttaatttttaatattgaacaaacttttaggcttgat

SEQ ID NO: 776 - DNA, 200 bp, Conyza canadensis
ttattttattatttttaaactgctacttttgattaatcattaatttcatatgaacattttaatataaacatttttgcatctgaaaatgtttttccatctgctaaggatgaaaggaccaaaatgcccttccatgctgttcaatgtttttcataatttaaaaggttatatatatatttattaatctagctagtgattatata

SEQ ID NO: 777 - DNA, 200 bp, Conyza canadensis
tatataatcactagctagattaataaatatatatataaccttttaaattatgaaaaacattgaacagcatggaagggcattttggtcctttcatccttagcagatggaaaaacattttcagatgcaaaaatgtttatattaaaatgttcatatgaaattaatgattaatcaaaagtagcagtttaaaaataataaaataa

SEQ ID NO: 778 - DNA, 200 bp, Conyza canadensis
tattaatctagctagtgattatatatgttgccttttgaatctgatgatctttttttggccagctacttgaatattgttaaataaatttagaaaaataaatatatgaatgataagttttaacttttaggtaaaaggatcttgataagcaatagctgaaagtccggagctagaaagggcttggtattggtgggacgtaattg

SEQ ID NO: 779 - DNA, 200 bp, Conyza canadensis
caattacgtcccaccaataccaagccctttctagctccggactttcagctattgcttatcaagatccttttacctaaaagttaaaacttatcattcatatatttatttttctaaatttatttaacaatattcaagtagctggccaaaaaaagatcatcagattcaaaaggcaacatatataatcactagctagattaata

SEQ ID NO: 780 - DNA, 200 bp, Conyza canadensis
gcttggtattggtgggacgtaattgaaaagatatacaaaattaaacatttatgatttttgcatctgtttgtatttagtgtgtcgaatgaaaagtaaatgtataaagagttgtgataaatttttggatccgaactggtacagtggtacattacagacacgggcgaaagcttggagtgttactttgatcctagatcttaata

SEQ ID NO: 781 - DNA, 200 bp, Conyza canadensis
tattaagatctaggatcaaagtaacactccaagctttcgcccgtgtctgtaatgtaccactgtaccagttcggatccaaaaatttatcacaactctttatacatttacttttcattcgacacactaaatacaaacagatgcaaaaatcataaatgtttaattttgtatatcttttcaattacgtcccaccaataccaagc

SEQ ID NO: 782 - DNA, 200 bp, Conyza canadensis
gttactttgatcctagatcttaatagacgagattcgttacatattaactaataatagaaatgcagcaatgccccccttgtttatattaaagattcatttttctcatgtgtgaattatgattttttgataagacaaaagttgtttacttgaagttgaatgatgtgggttcctacttgttttaaaaatgtgtaacctcttat

SEQ ID NO: 783 - DNA, 200 bp, Conyza canadensis
ataagaggttacacatttttaaaacaagtaggaacccacatcattcaacttcaagtaaacaacttttgtcttatcaaaaaatcataattcacacatgagaaaaatgaatctttaatataaacaaggggggcattgctgcatttctattattagttaatatgtaacgaatctcgtctattaagatctaggatcaaagtaac

SEQ ID NO: 784 - DNA, 200 bp, Conyza canadensis
gttttaaaaatgtgtaacctcttatctaaaaactctgtacttacgatgatcacaagaacctgcattgctgaccatttatcttatttattgatatttttgtgtctgataatatgggtaggtgaaaatggcacaatgtttggctccttcagtacaatggcagatgaggttaacaaaaaatggtatggaatcaagctctatgt

SEQ ID NO: 785 - DNA, 200 bp, Conyza canadensis
acatagagcttgattccataccattttttgttaacctcatctgccattgtactgaaggagccaaacattgtgccattttcacctacccatattatcagacacaaaaatatcaataaataagataaatggtcagcaatgcaggttcttgtgatcatcgtaagtacagagtttttagataagaggttacacatttttaaaac

SEQ ID NO: 786 - DNA, 200 bp, Conyza canadensis
aatggtatggaatcaagctctatgtcatccaaaatgtggaactctttgtccttgaagcaaagcaagaaaggagcacttaagaacgccacaaaattcagcatctgtgcttcagcaaatggaaccattaacaggatggaagacctactaaacttggatgtcactccttacaccaataagatcattgctgaatacatttggta

SEQ ID NO: 787 - DNA, 200 bp, Conyza canadensis
taccaaatgtattcagcaatgatcttattggtgtaaggagtgacatccaagtttagtaggtcttccatcctgttaatggttccatttgctgaagcacagatgctgaattttgtggcgttcttaagtgctcctttcttgctttgcttcaaggacaaagagttccacattttggatgacatagagcttgattccataccatt

SEQ ID NO: 788 - DNA, 200 bp, Conyza canadensis
agatcattgctgaatacatttggtatatttcattctttggatacacttaccatacaaatttcaggcttactaacatattaacaaaagtttgttacgttactctaaaggcttgttcaattcttatttagtcctatgctttctactttctgaaacaggattggaggttctgggacagatgtgcgcagcaaatcaagggtatg

SEQ ID NO: 789 - DNA, 200 bp, Conyza canadensis
catacccttgatttgctgcgcacatctgtcccagaacctccaatcctgtttcagaaagtagaaagcataggactaaataagaattgaacaagcctttagagtaacgtaacaaacttttgttaatatgttagtaagcctgaaatttgtatggtaagtgtatccaaagaatgaaatataccaaatgtattcagcaatgatct

SEQ ID NO: 790 - DNA, 200 bp, Conyza canadensis
atgtgcgcagcaaatcaagggtatgttgggttttgatgctttggtttctttcagtaattatctatagcttcgctaaaaggaaagattgtaatatatgtttcattatatctcttgtagacactctcaaaaccagttgagcatccttctgagcttccaaaatggaactatgatggatcaagtactggacaagctccaggaga

SEQ ID NO: 791 - DNA, 200 bp, Conyza canadensis
tctcctggagcttgtccagtacttgatccatcatagttccattttggaagctcagaaggatgctcaactggttttgagagtgtctacaagagatataatgaaacatatattacaatctttccttttagcgaagctatagataattactgaaagaaaccaaagcatcaaaacccaacatacccttgatttgctgcgcacat

SEQ ID NO: 792 - DNA, 200 bp, Conyza canadensis
caagtactggacaagctccaggagaagatagtgaagttatcttatagtaagttttatttcaaaaaatcacaagtctctttacatgtggtgatgtaaccaaagttgaaattctgtatttcagcccccaggcaatctttaaggatcctttccgtggtggcaacaacatcttggtgagtataacgttggttcattatactata

SEQ ID NO: 793 - DNA, 200 bp, Conyza canadensis
tatagtataatgaaccaacgttatactcaccaagatgttgttgccaccacggaaaggatccttaaagattgcctgggggctgaaatacagaatttcaactttggttacatcaccacatgtaaagagacttgtgattttttgaaataaaacttactataagataacttcactatcttctcctggagcttgtccagtacttg

SEQ ID NO: 794 - DNA, 200 bp, Conyza canadensis
tataacgttggttcattatactataaagtcttatgtataagctgagaaactcccaccaaccaaaaggttgcagtttcgagttctatatggacaagtgcatgcgaattttttccccttgaaaaataaggatacaaactgaaattggacaacatatggcttaaactgattctgtactgtttttataggtgatctgtgacgca

SEQ ID NO: 795 - DNA, 200 bp, Conyza canadensis
tgcgtcacagatcacctataaaaacagtacagaatcagtttaagccatatgttgtccaatttcagtttgtatccttatttttcaaggggaaaaaattcgcatgcacttgtccatatagaactcgaaactgcaaccttttggttggtgggagtttctcagcttatacataagactttatagtataatgaaccaacgttata

SEQ ID NO: 796 - DNA, 200 bp, Conyza canadensis
gtttttataggtgatctgtgacgcatacactccgcaaggcgagcctatccctactaacaaacgtgctaaggctgctgagattttcagtaatcctaaagttgtatcgcaagtgccctggtaggctttttgggtgaaaatgttcttttttttcccccatagaactaaactcttaaatccctgtgtttgataattgatacata

SEQ ID NO: 797 - DNA, 200 bp, Conyza canadensis
tatgtatcaattatcaaacacagggatttaagagtttagttctatgggggaaaaaaaagaacattttcacccaaaaagcctaccagggcacttgcgatacaactttaggattactgaaaatctcagcagccttagcacgtttgttagtagggataggctcgccttgcggagtgtatgcgtcacagatcacctataaaaac

SEQ ID NO: 798 - DNA, 200 bp, Conyza canadensis
ccctgtgtttgataattgatacatacattaaacttcttgtcacatgaataaggggcagataggtctgactttattagtcaacatacacctcccttttatgtgaacggggatactctactaaaacaacaaaataaacaaatattgcctctgtttatttcccggtaaaattgattttaaatttggttttaggtttggaattg

SEQ ID NO: 799 - DNA, 200 bp, Conyza canadensis
caattccaaacctaaaaccaaatttaaaatcaattttaccgggaaataaacagaggcaatatttgtttattttgttgttttagtagagtatccccgttcacataaaagggaggtgtatgttgactaataaagtcagacctatctgccccttattcatgtgacaagaagtttaatgtatgtatcaattatcaaacacaggg

SEQ ID NO: 800 - DNA, 200 bp, Conyza canadensis
aaatttggttttaggtttggaattgagcaagagtacactttgcttcagacagatgtgaagtggcctttgggttggcctgttggaggctaccctggtcctcaggtactattcatgatctaacttttgtaaacttctacaccttcctcatttataaatgggatttaatatcagttaaagctaaaggtggcaaaatgagtggg

SEQ ID NO: 801 - DNA, 200 bp, Conyza canadensis
cccactcattttgccacctttagctttaactgatattaaatcccatttataaatgaggaaggtgtagaagtttacaaaagttagatcatgaatagtacctgaggaccagggtagcctccaacaggccaacccaaaggccacttcacatctgtctgaagcaaagtgtactcttgctcaattccaaacctaaaaccaaattt

SEQ ID NO: 802 - DNA, 200 bp, Conyza canadensis
agctaaaggtggcaaaatgagtgggctagattgacctgaaagacttttttttaaactaattttttagttttccctatttataattagtgtgccaaatattgttataatcatttaatttcaaaaatagtttatctttttttgagtaaccattatactaaattcactcgtttgaaccattagagataaagcataactgaaga

SEQ ID NO: 803 - DNA, 200 bp, Conyza canadensis
tcttcagttatgctttatctctaatggttcaaacgagtgaatttagtataatggttactcaaaaaaagataaactatttttgaaattaaatgattataacaatatttggcacactaattataaatagggaaaactaaaaaattagtttaaaaaaaagtctttcaggtcaatctagcccactcattttgccacctttagct

SEQ ID NO: 804 - DNA, 200 bp, Conyza canadensis
attagagataaagcataactgaagagcgattctttcataagcaatgaatgaaattttccacccttaaaaacaagtgttcttattaaatgtatttccttttgaaactacagggtccatactactgtggtgctggagctgataagtcgtttggaagagatatatcggatgcacattacaaggcctgcctgtatgccggaatt

SEQ ID NO: 805 - DNA, 200 bp, Conyza canadensis
aattccggcatacaggcaggccttgtaatgtgcatccgatatatctcttccaaacgacttatcagctccagcaccacagtagtatggaccctgtagtttcaaaaggaaatacatttaataagaacacttgtttttaagggtggaaaatttcattcattgcttatgaaagaatcgctcttcagttatgctttatctctaat

SEQ ID NO: 806 - DNA, 200 bp, Conyza canadensis
caaggcctgcctgtatgccggaattaacatcagtgggaccaatggagaagttatgcctggacaggttttttttctacttcttcaccttattatctaatgaattatgaaaagaagtatcatggcaacaattgtgtttcacagtgggaatttcaagttggtcctagtgtgggaattgaagctggagaccatatctggtgtgc

SEQ ID NO: 807 - DNA, 200 bp, Conyza canadensis
gcacaccagatatggtctccagcttcaattcccacactaggaccaacttgaaattcccactgtgaaacacaattgttgccatgatacttcttttcataattcattagataataaggtgaagaagtagaaaaaaaacctgtccaggcataacttctccattggtcccactgatgttaattccggcatacaggcaggccttg

SEQ ID NO: 808 - DNA, 200 bp, Conyza canadensis
aagctggagaccatatctggtgtgctagatacctccttgaggtaaatcatcttcagcaatttgatacagtaacaacttaatatatcctaccgtgtttttttaatctatatctaattgtttcttgtgactttactgtatttaacagagaattactgaacaagctggtgtcgtgttgacccttgaccctaagcctattgatg

SEQ ID NO: 809 - DNA, 200 bp, Conyza canadensis
catcaataggcttagggtcaagggtcaacacgacaccagcttgttcagtaattctctgttaaatacagtaaagtcacaagaaacaattagatatagattaaaaaaacacggtaggatatattaagttgttactgtatcaaattgctgaagatgatttacctcaaggaggtatctagcacaccagatatggtctccagctt

SEQ ID NO: 810 - DNA, 200 bp, Conyza canadensis
acccttgaccctaagcctattgatgtaagatatatcttgtttgatgactactttccttcaattttccatcatagtgttcaaatcttgcttagggagaacatttgagcaacatgtaatgtcactcttttgtaattagaggtggttagataggcatgttggttaatgtgtccaaatgtacaattctttgatgacacaagctt

SEQ ID NO: 811 - DNA, 200 bp, Conyza canadensis
aagcttgtgtcatcaaagaattgtacatttggacacattaaccaacatgcctatctaaccacctctaattacaaaagagtgacattacatgttgctcaaatgttctccctaagcaagatttgaacactatgatggaaaattgaaggaaagtagtcatcaaacaagatatatcttacatcaataggcttagggtcaagggt

SEQ ID NO: 812 - DNA, 200 bp, Conyza canadensis
tacaattctttgatgacacaagcttagttgaccataaacacttttttccttttgtttttcttacaaaaaagacgaacaagataattggcaattcaagctatattaaaattcaaaaatttaaactttttgagtaaaaaggaatttcaggaggtgttatgagctaataaaagtatacattttaggtcactcatttgtgtcga

SEQ ID NO: 813 - DNA, 200 bp, Conyza canadensis
tcgacacaaatgagtgacctaaaatgtatacttttattagctcataacacctcctgaaattcctttttactcaaaaagtttaaatttttgaattttaatatagcttgaattgccaattatcttgttcgtcttttttgtaagaaaaacaaaaggaaaaaagtgtttatggtcaactaagcttgtgtcatcaaagaattgta

SEQ ID NO: 814 - DNA, 200 bp, Conyza canadensis
attttaggtcactcatttgtgtcgatttcattttaagctacttctattgggtttaacaatgggaggcacagaaaacgcctcagttgaccctttgataactaaacgggttgaatttgccacctctacccgctctgaatgattctgattttattcttaacttacacaacgcttgttgatttgaattggcagggagactggaa

SEQ ID NO: 815 - DNA, 200 bp, Conyza canadensis
ttccagtctccctgccaattcaaatcaacaagcgttgtgtaagttaagaataaaatcagaatcattcagagcgggtagaggtggcaaattcaacccgtttagttatcaaagggtcaactgaggcgttttctgtgcctcccattgttaaacccaatagaagtagcttaaaatgaaatcgacacaaatgagtgacctaaaat

SEQ ID NO: 816 - DNA, 200 bp, Conyza canadensis
atttgaattggcagggagactggaatggagcaggatgccacactaactacaggtacttgttttctttactcataatagacctgcgtattgtttttgaaacgctctaatgtgtgtgaacgttgatttctttcttatattaaaaatccattcacttacttttgtgctttcaaatttcagtacattggccatgagagaagaag

SEQ ID NO: 817 - DNA, 200 bp, Conyza canadensis
cttcttctctcatggccaatgtactgaaatttgaaagcacaaaagtaagtgaatggatttttaatataagaaagaaatcaacgttcacacacattagagcgtttcaaaaacaatacgcaggtctattatgagtaaagaaaacaagtacctgtagttagtgtggcatcctgctccattccagtctccctgccaattcaaat

SEQ ID NO: 818 - DNA, 200 bp, Conyza canadensis
agtacattggccatgagagaagaaggtgggtttgaagtaattaaaaaggcgattctgaacttgtcacttcgccacactgagcacatcagtgcttatggagaaggcaatgagagaagattgacagggaagcacgaaactgccagcattaaccagttttcatgggtataaaacattttatatcgaattataagagataaacc

SEQ ID NO: 819 - DNA, 200 bp, Conyza canadensis
ggtttatctcttataattcgatataaaatgttttatacccatgaaaactggttaatgctggcagtttcgtgcttccctgtcaatcttctctcattgccttctccataagcactgatgtgctcagtgtggcgaagtgacaagttcagaatcgcctttttaattacttcaaacccaccttcttctctcatggccaatgtact

SEQ ID NO: 820 - DNA, 200 bp, Conyza canadensis
tatatcgaattataagagataaaccaaaaaaaataatttacactttcataagctttctcaactgatggtttttgtattcggtgaacttgcagggtgtagcaaatcgtggttgctcaatccgtgtggggcgtgacactgagagggaaggcaaaggtattgctatcttcacactacagtctttatcattggtggataattgg

SEQ ID NO: 821 - DNA, 200 bp, Conyza canadensis
ccaattatccaccaatgataaagactgtagtgtgaagatagcaatacctttgccttccctctcagtgtcacgccccacacggattgagcaaccacgatttgctacaccctgcaagttcaccgaatacaaaaaccatcagttgagaaagcttatgaaagtgtaaattattttttttggtttatctcttataattcgatata

SEQ ID NO: 822 - DNA, 200 bp, Conyza canadensis
gtctttatcattggtggataattggatattggtaactcgtcaaactgggtaaatatatgttatggttcaacgtgttgggatgaccaaataaacattttatataattatcaaaatcttcataaacatattgttaatataccaaacatgtttccagaaattataaaatttcaacagtaatctgccttcttgaattaatcgat

SEQ ID NO: 823 - DNA, 200 bp, Conyza canadensis
atcgattaattcaagaaggcagattactgttgaaattttataatttctggaaacatgtttggtatattaacaatatgtttatgaagattttgataattatataaaatgtttatttggtcatcccaacacgttgaaccataacatatatttacccagtttgacgagttaccaatatccaattatccaccaatgataaagac

SEQ ID NO: 824 - DNA, 200 bp, Conyza canadensis
aatctgccttcttgaattaatcgatttaggaggtgtaatgcattagaatcacaaatcgccaactgattttatttttattttttctttctgaaataacctaaattgaccgttcattagtgagtctaaatttccacctttaaaaaaattctctttcgaaatctgttttttcacgggtcatgtttactatgtgcaggttattt

SEQ ID NO: 825 - DNA, 200 bp, Conyza canadensis
aaataacctgcacatagtaaacatgacccgtgaaaaaacagatttcgaaagagaatttttttaaaggtggaaatttagactcactaatgaacggtcaatttaggttatttcagaaagaaaaaataaaaataaaatcagttggcgatttgtgattctaatgcattacacctcctaaatcgattaattcaagaaggcagatt

SEQ ID NO: 826 - DNA, 200 bp, Conyza canadensis
catgtttactatgtgcaggttatttggaagacagacgcccggcatcaaacatggacccgtacaccgtgaccggattactcgccgaaacaaccatcctttgggagcctacccttgaggctgaagcacttgctgcccagaagttggcattgaatgtgtaagactctcccacgaggtgatatacaacgaagaaagtgtcaaca

SEQ ID NO: 827 - DNA, 200 bp, Conyza canadensis
tgttgacactttcttcgttgtatatcacctcgtgggagagtcttacacattcaatgccaacttctgggcagcaagtgcttcagcctcaagggtaggctcccaaaggatggttgtttcggcgagtaatccggtcacggtgtacgggtccatgtttgatgccgggcgtctgtcttccaaataacctgcacatagtaaacatg

SEQ ID NO: 828 - DNA, 200 bp, Conyza canadensis
atatacaacgaagaaagtgtcaacatgcatattcatccatgttcttcgtaaactcggtttcctgtttctagttgatttcttgaagatcttgtaaataaaggtcatcactgcttcaaattcaagctatttttagcaaatgggtgtttttcagatgattattggacagtttatgcacaatttgaagtgtgcacaagtgcact

SEQ ID NO: 829 - DNA, 200 bp, Conyza canadensis
agtgcacttgtgcacacttcaaattgtgcataaactgtccaataatcatctgaaaaacacccatttgctaaaaatagcttgaatttgaagcagtgatgacctttatttacaagatcttcaagaaatcaactagaaacaggaaaccgagtttacgaagaacatggatgaatatgcatgttgacactttcttcgttgtatat

SEQ ID NO: 830 - DNA, 200 bp, Conyza canadensis
aatttgaagtgtgcacaagtgcacttgacccggtctgagcagacattattttctcttcttgatttaaagaaagcaccctcacattttgggggtattttctcttcatttgatcatatcatataattatcaatcggtttagatgggctgctgctccttttttggtcaattttattactagattgcttgtcaatgctaattat

SEQ ID NO: 831 - DNA, 200 bp, Conyza canadensis
ataattagcattgacaagcaatctagtaataaaattgaccaaaaaaggagcagcagcccatctaaaccgattgataattatatgatatgatcaaatgaagagaaaatacccccaaaatgtgagggtgctttctttaaatcaagaagagaaaataatgtctgctcagaccgggtcaagtgcacttgtgcacacttcaaatt

SEQ ID NO: 832 - DNA, 200 bp, Conyza canadensis
tagattgcttgtcaatgctaattatttcgttaaaattggaaaatgatgtaattcatacttacaattcttactgcgaaaagggaggctaaataacagtagaacactagaacttcaacaacaacgagagttataatacaagagagttaaataagcatttatataacttaactaagtaaaatatacaactatctcttttgccc

SEQ ID NO: 833 - DNA, 200 bp, Conyza canadensis
gggcaaaagagatagttgtatattttacttagttaagttatataaatgcttatttaactctcttgtattataactctcgttgttgttgaagttctagtgttctactgttatttagcctcccttttcgcagtaagaattgtaagtatgaattacatcattttccaattttaacgaaataattagcattgacaagcaatcta

SEQ ID NO: 834 - DNA, 200 bp, Conyza canadensis
aaatatacaactatctcttttgccctccctgcttgaaaacaatggacttaatattgtggaatcacagtcaggaatctcaacgagttaaaaaaaatgacgatgatgtacgttaccattttttagttatacatcacaaacatgtgttctatcatacaatgatgtgaaacatgtatgtgttggtcaatggtcataataaaatc

SEQ ID NO: 835 - DNA, 200 bp, Conyza canadensis
gattttattatgaccattgaccaacacatacatgtttcacatcattgtatgatagaacacatgtttgtgatgtataactaaaaaatggtaacgtacatcatcgtcattttttttaactcgttgagattcctgactgtgattccacaatattaagtccattgttttcaagcagggagggcaaaagagatagttgtatattt

SEQ ID NO: 836 - DNA, 200 bp, Conyza canadensis
gttggtcaatggtcataataaaatcatatgcacgaaccgaccaactaggaaaggatggattgttcagaccttgatggattaagatcaaaacaaatgtctctacggtaatgttatcatctagtagctagtaattggttatagaaacaatcgttacacaaatcatctactaaaattacaatagtaaaaaccatctttcaacc

SEQ ID NO: 837 - DNA, 200 bp, Conyza canadensis
ggttgaaagatggtttttactattgtaattttagtagatgatttgtgtaacgattgtttctataaccaattactagctactagatgataacattaccgtagagacatttgttttgatcttaatccatcaaggtctgaacaatccatcctttcctagttggtcggttcgtgcatatgattttattatgaccattgaccaac

SEQ ID NO: 838 - DNA, 200 bp, Conyza canadensis
caatagtaaaaaccatctttcaaccattgtcaaactaacaatgtattacacattcaaccggttactagtctatagatagtttttattattggttacatggtttgtagtttccataatgtaatcaaagttcgttattattttacctgattagtggtacccatcatgtgaccacacgatcttacatataaaagttaaagcaa

SEQ ID NO: 839 - DNA, 200 bp, Conyza canadensis
ttgctttaacttttatatgtaagatcgtgtggtcacatgatgggtaccactaatcaggtaaaataataacgaactttgattacattatggaaactacaaaccatgtaaccaataataaaaactatctatagactagtaaccggttgaatgtgtaatacattgttagtttgacaatggttgaaagatggtttttactattg

SEQ ID NO: 840 - DNA, 200 bp, Conyza canadensis
atcttacatataaaagttaaagcaagtggagaaaccatatatcttgtgatccatgtgtgagaataatgatttatcgaatattagtcttatgtggtgtgcgagctagataagaaaatagtatatatgttttatgaaatgatccgcggtttacaggaccaaagagttctagctcgttcacctttttatttaactttaggctg

SEQ ID NO: 841 - DNA, 200 bp, Conyza canadensis
cagcctaaagttaaataaaaaggtgaacgagctagaactctttggtcctgtaaaccgcggatcatttcataaaacatatatactattttcttatctagctcgcacaccacataagactaatattcgataaatcattattctcacacatggatcacaagatatatggtttctccacttgctttaacttttatatgtaagat

SEQ ID NO: 842 - DNA, 200 bp, Conyza canadensis
cacctttttatttaactttaggctgaagacattaaaaaaaaaaaaaggttataatactactttgacctccattgaaaccaaaactatttgtctttccaaacagtctcccaaatgtacacccaacttcttcaaactcacccaatcttcactttcaaaccctgttcaatctcttccagccatccccttatcttcatcaacac

SEQ ID NO: 843 - DNA, 200 bp, Conyza canadensis
gtgttgatgaagataaggggatggctggaagagattgaacagggtttgaaagtgaagattgggtgagtttgaagaagttgggtgtacatttgggagactgtttggaaagacaaatagttttggtttcaatggaggtcaaagtagtattataacctttttttttttttaatgtcttcagcctaaagttaaataaaaaggtg

SEQ ID NO: 844 - DNA, 200 bp, Conyza canadensis
gccatccccttatcttcatcaacaccagtcaccaatttcccataaaccaaagacccccaaattcatcctttcattacaatcacaaaaccctgttcaaaactctcataaactgtactcaaaatgccgattctaatacaccaaaatgggaaaacttgttgccaaagaatgtaatctctgctgagaaaatattgaggtcaatt

SEQ ID NO: 845 - DNA, 200 bp, Conyza canadensis
aattgacctcaatattttctcagcagagattacattctttggcaacaagttttcccattttggtgtattagaatcggcattttgagtacagtttatgagagttttgaacagggttttgtgattgtaatgaaaggatgaatttgggggtctttggtttatgggaaattggtgactggtgttgatgaagataaggggatggc

SEQ ID NO: 846 - DNA, 200 bp, Conyza canadensis
tgctgagaaaatattgaggtcaattgctggggcaacttctagtcctatttgtcagttcatctcttcacctactactttcttgcactctgttgaccccaggattaaattggtaaagtttgttgcttttttgaaaattcttgttattggtttttgggttttttctttattgataattttaagtctttaaccatattgtgatg

SEQ ID NO: 847 - DNA, 200 bp, Conyza canadensis
catcacaatatggttaaagacttaaaattatcaataaagaaaaaacccaaaaaccaataacaagaattttcaaaaaagcaacaaactttaccaatttaatcctggggtcaacagagtgcaagaaagtagtaggtgaagagatgaactgacaaataggactagaagttgccccagcaattgacctcaatattttctcagca

SEQ ID NO: 848 - DNA, 200 bp, Conyza canadensis
ttaagtctttaaccatattgtgatgtgatttaccttcttctttcatgttgagtgttgggctggtcagggggaatgggtcagttacccatttattctgatggtgtgcttttatgatttaagttgataaattccatgactttttaggggattcttgcaattcttcctgggtattgctttattgggtattttgtaaattggtt

SEQ ID NO: 849 - DNA, 200 bp, Conyza canadensis
aaccaatttacaaaatacccaataaagcaatacccaggaagaattgcaagaatcccctaaaaagtcatggaatttatcaacttaaatcataaaagcacaccatcagaataaatgggtaactgacccattccccctgaccagcccaacactcaacatgaaagaagaaggtaaatcacatcacaatatggttaaagacttaa

SEQ ID NO: 850 - DNA, 200 bp, Conyza canadensis
ttattgggtattttgtaaattggtttatatgctttagtatgtgttagttcaatttgttcattgttgttgaaaatatgttgtgaaacatagccatggctttgatggtcgtgcttttttgtataaaaagttgtttttatctttatgtaagaaaagatagagtgtcactagtagtctctgtgatggtagcttagttgccggga

SEQ ID NO: 851 - DNA, 200 bp, Conyza canadensis
tcccggcaactaagctaccatcacagagactactagtgacactctatcttttcttacataaagataaaaacaactttttatacaaaaaagcacgaccatcaaagccatggctatgtttcacaacatattttcaacaacaatgaacaaattgaactaacacatactaaagcatataaaccaatttacaaaatacccaataa

SEQ ID NO: 852 - DNA, 200 bp, Conyza canadensis
tgtgatggtagcttagttgccgggaaagttaagtttaatgcactttaggtggtgcggagttcacgctcttgcatttttttttatttttattttttgcattgtcttgcagtagaatttgcttatccttagggacctgattgggttgaaatactacttaagaaaagtaagtttatagtgatcagagcattatccaagtcagt

SEQ ID NO: 853 - DNA, 200 bp, Conyza canadensis
actgacttggataatgctctgatcactataaacttacttttcttaagtagtatttcaacccaatcaggtccctaaggataagcaaattctactgcaagacaatgcaaaaaataaaaataaaaaaaaatgcaagagcgtgaactccgcaccacctaaagtgcattaaacttaactttcccggcaactaagctaccatcaca

SEQ ID NO: 854 - DNA, 200 bp, Conyza canadensis
catggatggattctacattgcccggtactaacgtactcgtaggagctcatgacagcaaaaatgggttccagcatcttggggagcttggaaaagggaatcaaccatacccacacccctatctctttaggaaaggccaatctcccctcctttgttttctccttttattttttatatatactttttattaaaataaaacatat

SEQ ID NO: 855 - DNA, 200 bp, Conyza canadensis
atatgttttattttaataaaaagtatatataaaaaataaaaggagaaaacaaaggaggggagattggcctttcctaaagagataggggtgtgggtatggttgattcccttttccaagctccccaagatgctggaacccatttttgctgtcatgagctcctacgagtacgttagtaccgggcaatgtagaatccatccatg

SEQ ID NO: 856 - DNA, 200 bp, Conyza canadensis
tactttttattaaaataaaacatatactatttatttatttttacatccatttatcaaacaaacttgcaactttcttcttttcattcattttgccgctctcaaccatcacttttctctactttccggccggtgaaaatggcacaatgtttggctccttcagtacaatggcagatgaggttaacaaaaaatggtatggaatc

SEQ ID NO: 857 - DNA, 200 bp, Conyza canadensis
gattccataccattttttgttaacctcatctgccattgtactgaaggagccaaacattgtgccattttcaccggccggaaagtagagaaaagtgatggttgagagcggcaaaatgaatgaaaagaagaaagttgcaagtttgtttgataaatggatgtaaaaataaataaatagtatatgttttattttaataaaaagta

SEQ ID NO: 858 - DNA, 200 bp, Conyza canadensis
ggttaacaaaaaatggtatggaatcaagctctatgtcatccaaaatgtggaactctttgtccttgaagcaaagcaagaaaggagcacttaagaacgccacaaaattcagcatctgtgcttcagcaaatggaaccattaacaggatggaagacctactaaacttggatgtcactccttacaccaataagatcattgctgaa

SEQ ID NO: 859 - DNA, 200 bp, Conyza canadensis
ttcagcaatgatcttattggtgtaaggagtgacatccaagtttagtaggtcttccatcctgttaatggttccatttgctgaagcacagatgctgaattttgtggcgttcttaagtgctcctttcttgctttgcttcaaggacaaagagttccacattttggatgacatagagcttgattccataccattttttgttaacc

SEQ ID NO: 860 - DNA, 200 bp, Conyza canadensis
ttacaccaataagatcattgctgaatacatttggattggaggttctgggacagatgtgcgcagcaaatcaaggacactctcaaaaccagttgagcatccttctgagcttccaaaatggaactatgatggatcaagtactggacaagctccaggagaagatagtgaagttatcttatacccccaggcaatctttaaggatc

SEQ ID NO: 861 - DNA, 200 bp, Conyza canadensis
gatccttaaagattgcctgggggtataagataacttcactatcttctcctggagcttgtccagtacttgatccatcatagttccattttggaagctcagaaggatgctcaactggttttgagagtgtccttgatttgctgcgcacatctgtcccagaacctccaatccaaatgtattcagcaatgatcttattggtgtaa

SEQ ID NO: 862 - DNA, 200 bp, Conyza canadensis
tacccccaggcaatctttaaggatcctttccgtggtggcaacaacatcttggtgatctgtgacgcatacactccgcaaggcgagcctatccctactaacaaacgtgctaaggctgctgagattttcagtaatcctaaagttgtatcgcaagtgccctggtttggaattgagcaagagtacactttgcttcagacagatgt

SEQ ID NO: 863 - DNA, 200 bp, Conyza canadensis
acatctgtctgaagcaaagtgtactcttgctcaattccaaaccagggcacttgcgatacaactttaggattactgaaaatctcagcagccttagcacgtttgttagtagggataggctcgccttgcggagtgtatgcgtcacagatcaccaagatgttgttgccaccacggaaaggatccttaaagattgcctgggggta

SEQ ID NO: 864 - DNA, 200 bp, Conyza canadensis
agtacactttgcttcagacagatgtgaagtggcctttgggttggcctgttggaggctaccctggtcctcagggtccatactactgtggtgctggagctgataagtcgtttggaagagatatatcggatgcacattacaaggcctgcctgtatgccggaattaacatcagtgggaccaatggagaagttatgcctggacag

SEQ ID NO: 865 - DNA, 200 bp, Conyza canadensis
ctgtccaggcataacttctccattggtcccactgatgttaattccggcatacaggcaggccttgtaatgtgcatccgatatatctcttccaaacgacttatcagctccagcaccacagtagtatggaccctgaggaccagggtagcctccaacaggccaacccaaaggccacttcacatctgtctgaagcaaagtgtact

SEQ ID NO: 866 - DNA, 200 bp, Conyza canadensis
caatggagaagttatgcctggacagtgggaatttcaagttggtcctagtgtgggaattgaagctggagaccatatctggtgtgctagatacctccttgagagaattactgaacaagctggtgtcgtgttgacccttgaccctaagcctattgatggagactggaatggagcaggatgccacactaactacagtacattgg

SEQ ID NO: 867 - DNA, 200 bp, Conyza canadensis
ccaatgtactgtagttagtgtggcatcctgctccattccagtctccatcaataggcttagggtcaagggtcaacacgacaccagcttgttcagtaattctctcaaggaggtatctagcacaccagatatggtctccagcttcaattcccacactaggaccaacttgaaattcccactgtccaggcataacttctccattg

SEQ ID NO: 868 - DNA, 200 bp, Conyza canadensis
tgccacactaactacagtacattggccatgagagaagaaggtgggtttgaagtaattaaaaaggcgattctgaacttgtcacttcgccacactgagcacatcagtgcttatggagaaggcaatgagagaagattgacagggaagcacgaaactgccagcattaaccagttttcatggggtgtagcaaatcgtggttgctc

SEQ ID NO: 869 - DNA, 200 bp, Conyza canadensis
gagcaaccacgatttgctacaccccatgaaaactggttaatgctggcagtttcgtgcttccctgtcaatcttctctcattgccttctccataagcactgatgtgctcagtgtggcgaagtgacaagttcagaatcgcctttttaattacttcaaacccaccttcttctctcatggccaatgtactgtagttagtgtggca

SEQ ID NO: 870 - DNA, 200 bp, Conyza canadensis
ggggtgtagcaaatcgtggttgctcaatccgtgtggggcgtgacactgagagggaaggcaaaggttatttggaagacagacgcccggcatcaaacatggacccgtacaccgtgaccggattactcgccgaaacaaccatcctttgggagcctacccttgaggctgaagcacttgctgcccagaagttggcattgaatgtg

SEQ ID NO: 871 - DNA, 200 bp, Conyza canadensis
cacattcaatgccaacttctgggcagcaagtgcttcagcctcaagggtaggctcccaaaggatggttgtttcggcgagtaatccggtcacggtgtacgggtccatgtttgatgccgggcgtctgtcttccaaataacctttgccttccctctcagtgtcacgccccacacggattgagcaaccacgatttgctacacccc

SEQ ID NO: 872 - DNA, 200 bp, Conyza canadensis
tgcccagaagttggcattgaatgtgtaagactctcccacgaggtgatatacaacgaagaaagtgtcaacatgcatattcatccatgttcttcgtaaactcggtttcctgtttctagttgatttcttgaagatcttgtaaataaaggtcatcactgcttcaaattcaagctatttttagcaaatgggtgtttttcagatga

SEQ ID NO: 873 - DNA, 200 bp, Conyza canadensis
tcatctgaaaaacacccatttgctaaaaatagcttgaatttgaagcagtgatgacctttatttacaagatcttcaagaaatcaactagaaacaggaaaccgagtttacgaagaacatggatgaatatgcatgttgacactttcttcgttgtatatcacctcgtgggagagtcttacacattcaatgccaacttctgggca

SEQ ID NO: 874 - DNA, 200 bp, Conyza canadensis
tagcaaatgggtgtttttcagatgattattggacagtttatgcacaatttgaagtgtgcacaagtgcacttgacccggtctgagcagacattattttctcttcttgatttaaagaaagcaccctcacattttgggggtattttctcttcatttgatcatatcatataattatcaatcggtttagatgggctgctgctcct

SEQ ID NO: 875 - DNA, 200 bp, Conyza canadensis
aggagcagcagcccatctaaaccgattgataattatatgatatgatcaaatgaagagaaaatacccccaaaatgtgagggtgctttctttaaatcaagaagagaaaataatgtctgctcagaccgggtcaagtgcacttgtgcacacttcaaattgtgcataaactgtccaataatcatctgaaaaacacccatttgcta

SEQ ID NO: 876 - DNA, 200 bp, Digitaria sanguinalis
ccttcacttcaaccaccactctccggccacttttccggcccctctccgtcactcctccggtgaaaatggcacaatgtttggctccttcagtgcaatggcagatgagggtaacaaagaacgcgatggaaccaaactctatgacatccaaaatgtttaactcttttgctttgaagccaagcaagaaaggagccatgaaaacc

SEQ ID NO: 877 - DNA, 200 bp, Digitaria sanguinalis
ggttttcatggctcctttcttgcttggcttcaaagcaaaagagttaaacattttggatgtcatagagtttggttccatcgcgttctttgttaccctcatctgccattgcactgaaggagccaaacattgtgccattttcaccggaggagtgacggagaggggccggaaaagtggccggagagtggtggttgaagtgaagg

SEQ ID NO: 878 - DNA, 200 bp, Digitaria sanguinalis
aagcaagaaaggagccatgaaaacctccacaaaatttagaatatgcgcttcagcaagtggaacgattaacaggatggaagacctgctaaatttggatgtgactccttacactgacaagatcattgctgaatacatttggattggaggttctgggacagacgttcgcagcaaatcgaggacaatctctaaaccagttgagc

SEQ ID NO: 879 - DNA, 200 bp, Digitaria sanguinalis
gctcaactggtttagagattgtcctcgatttgctgcgaacgtctgtcccagaacctccaatccaaatgtattcagcaatgatcttgtcagtgtaaggagtcacatccaaatttagcaggtcttccatcctgttaatcgttccacttgctgaagcgcatattctaaattttgtggaggttttcatggctcctttcttgctt

SEQ ID NO: 880 - DNA, 200 bp, Digitaria sanguinalis
aggacaatctctaaaccagttgagcatgcttctgagcttccaaagtggaactatgatggatcaagtactggacaagcacccggcgaagacagtgaagttatcttatacccccaggcaatctttaaggatcctttccgtggtggaaacaacattttggtgatctgtgatgcatatacgccacaaggcgagcctatcccaac

SEQ ID NO: 881 - DNA, 200 bp, Digitaria sanguinalis
gttgggataggctcgccttgtggcgtatatgcatcacagatcaccaaaatgttgtttccaccacggaaaggatccttaaagattgcctgggggtataagataacttcactgtcttcgccgggtgcttgtccagtacttgatccatcatagttccactttggaagctcagaagcatgctcaactggtttagagattgtcct

SEQ ID NO: 882 - DNA, 200 bp, Digitaria sanguinalis
cgccacaaggcgagcctatcccaacaaacaaacgtgctaaggctgctgagattttcagtgatcctaaagttgtagaacaggttccctggtttggaattgagcaagagtacactttgcttcaaccaaatgtgaagtggcctttgggttggccagttggaggctaccctggtcctcagggtccatactactgtggtgctgga

SEQ ID NO: 883 - DNA, 200 bp, Digitaria sanguinalis
tccagcaccacagtagtatggaccctgaggaccagggtagcctccaactggccaacccaaaggccacttcacatttggttgaagcaaagtgtactcttgctcaattccaaaccagggaacctgttctacaactttaggatcactgaaaatctcagcagccttagcacgtttgtttgttgggataggctcgccttgtggcg

SEQ ID NO: 884 - DNA, 200 bp, Digitaria sanguinalis
gggtccatactactgtggtgctggagcggataagtcctttggaagagacatttcagatgcacattacaaggcttgcttatatgctggaattaacatcagtggaaccaacggagaagttatgcctggacagtgggaattccaagttggtcctagtgtgggaattgaagcaggagaccatatctggtgtgctagatacctcc

SEQ ID NO: 885 - DNA, 200 bp, Digitaria sanguinalis
ggaggtatctagcacaccagatatggtctcctgcttcaattcccacactaggaccaacttggaattcccactgtccaggcataacttctccgttggttccactgatgttaattccagcatataagcaagccttgtaatgtgcatctgaaatgtctcttccaaaggacttatccgctccagcaccacagtagtatggaccc

SEQ ID NO: 886 - DNA, 200 bp, Digitaria sanguinalis
catatctggtgtgctagatacctccttgagagaattactgagcaagccggtgttgtcctgacacttgaccctaagccaattgagggagactggaatggagcaggatgccacactaactacagtacaaaagccatgagagaagaaggtggatttgaggtaatcaaaaaggcgattctaaacctttcacttcgccacactga

SEQ ID NO: 887 - DNA, 200 bp, Digitaria sanguinalis
tcagtgtggcgaagtgaaaggtttagaatcgcctttttgattacctcaaatccaccttcttctctcatggcttttgtactgtagttagtgtggcatcctgctccattccagtctccctcaattggcttagggtcaagtgtcaggacaacaccggcttgctcagtaattctctcaaggaggtatctagcacaccagatatg

SEQ ID NO: 888 - DNA, 200 bp, Digitaria sanguinalis
taaacctttcacttcgccacactgaacacatcagtgcttacggagaaggaaatgaaagaagattgacagggaaacatgaaactgccagcatcaaccaattttcatggggagtagctaatcgtggttgctcaatccgtgtggggcgtgacactgagaaagccggcaaaggttacttggaagacaggcgcccggcatcaaac

SEQ ID NO: 889 - DNA, 200 bp, Digitaria sanguinalis
gtttgatgccgggcgcctgtcttccaagtaacctttgccggctttctcagtgtcacgccccacacggattgagcaaccacgattagctactccccatgaaaattggttgatgctggcagtttcatgtttccctgtcaatcttctttcatttccttctccgtaagcactgatgtgttcagtgtggcgaagtgaaaggttta

SEQ ID NO: 890 - DNA, 200 bp, Digitaria sanguinalis
ggaagacaggcgcccggcatcaaacatggacccatatacagtgacaggattacttgcagaaaccaccatcctgtgggagcccacacttgaggctgaagccctcgcagctcagaagttggcattgaatgtctagggccgatccatgttctttgaaaattcggatttctgtttctagtttgatttcttcgacgtcttgtaaa

SEQ ID NO: 891 - DNA, 200 bp, Digitaria sanguinalis
tttacaagacgtcgaagaaatcaaactagaaacagaaatccgaattttcaaagaacatggatcggccctagacattcaatgccaacttctgagctgcgagggcttcagcctcaagtgtgggctcccacaggatggtggtttctgcaagtaatcctgtcactgtatatgggtccatgtttgatgccgggcgcctgtcttcc

SEQ ID NO: 892 - DNA, 200 bp, Digitaria sanguinalis
gaaggggaaaatgcctcatcatttcccttggaaagagagggtgtctaactttagcaagtgcatatgcggaatcggcaattaatactacagttgagattcatggaatcaaagatggaaagatacagaaatattcatttcaccacatgcgtggctgtaatgaataaccaaccaggtatttctgtactgtcactaatgtgctg

SEQ ID NO: 893 - DNA, 200 bp, Digitaria sanguinalis
cagcacattagtgacagtacagaaatacctggttggttattcattacagccacgcatgtggtgaaatgaatatttctgtatctttccatctttgattccatgaatctcaactgtagtattaattgccgattccgcatatgcacttgctaaagttagacaccctctctttccaagggaaatgatgaggcattttccccttc

SEQ ID NO: 894 - DNA, 200 bp, Digitaria sanguinalis
tttctgtactgtcactaatgtgctggcattgcagcaggacaaacctttcctcctttttcgtacggtgcatcacgtgccatgggttcataatctctagatcatgctcagagagactttctttttcttgcggaacaaaatatttgcacgcacgaaacaaaattagatggaccaactattattttgtgcgtaacatcttatag

SEQ ID NO: 895 - DNA, 200 bp, Digitaria sanguinalis
ctataagatgttacgcacaaaataatagttggtccatctaattttgtttcgtgcgtgcaaatattttgttccgcaagaaaaagaaagtctctctgagcatgatctagagattatgaacccatggcacgtgatgcaccgtacgaaaaaggaggaaaggtttgtcctgctgcaatgccagcacattagtgacagtacagaaa

SEQ ID NO: 896 - DNA, 200 bp, Digitaria sanguinalis
ttattttgtgcgtaacatcttatagatatataggaacggtccaaataatacaatacaatatcttatatagatatatgtgaaaatcaaaacaatatccttatggatattgacatattgtggaaaaatccaaacaactccacataatgtgacatgcatattgtatgaaaaatccaaactacaccatgatacacctcaaggat

SEQ ID NO: 897 - DNA, 200 bp, Digitaria sanguinalis
atccttgaggtgtatcatggtgtagtttggatttttcatacaatatgcatgtcacattatgtggagttgtttggatttttccacaatatgtcaatatccataaggatattgttttgattttcacatatatctatataagatattgtattgtattatttggaccgttcctatatatctataagatgttacgcacaaaataa

SEQ ID NO: 898 - DNA, 200 bp, Digitaria sanguinalis
ctacaccatgatacacctcaaggatgttgtgggaataattcaaacaacacgatagaacatcttctagatattgtagaagccatgcaaacaatacatgcaacatcttatagatattatgcgaaaataccaacaacactatggaatatctcttagatattgtagtaacaatccaaataacacaataaaatattttgtggata

SEQ ID NO: 899 - DNA, 200 bp, Digitaria sanguinalis
tatccacaaaatattttattgtgttatttggattgttactacaatatctaagagatattccatagtgttgttggtattttcgcataatatctataagatgttgcatgtattgtttgcatggcttctacaatatctagaagatgttctatcgtgttgtttgaattattcccacaacatccttgaggtgtatcatggtgtag

SEQ ID NO: 900 - DNA, 200 bp, Digitaria sanguinalis
aacacaataaaatattttgtggatataacgaacaatacaaaaacataatgaaacatctcacaaataatatatgaacaatcaaaatgacaccaccaaacatctcgtagataccatggaacatctcgtggatgttgcgaaaactgtcttaagaaatattgtgatatatattatgagacaattttttagaaaaaacatcatga

SEQ ID NO: 901 - DNA, 200 bp, Digitaria sanguinalis
tcatgatgttttttctaaaaaattgtctcataatatatatcacaatatttcttaagacagttttcgcaacatccacgagatgttccatggtatctacgagatgtttggtggtgtcattttgattgttcatatattatttgtgagatgtttcattatgtttttgtattgttcgttatatccacaaaatattttattgtgtt

SEQ ID NO: 902 - DNA, 200 bp, Digitaria sanguinalis
caattttttagaaaaaacatcatgaaatatgaggcaatccaagtaataccagagaaaatatcatattatagtaggaacaatctaatcaaatatcatacaaataatataaataacaccataaaatatctaatgaattatataaaaacagaacgcaggcacggagcaatgaaagcacagggcaatttccagcccttgtgccg

SEQ ID NO: 903 - DNA, 200 bp, Digitaria sanguinalis
cggcacaagggctggaaattgccctgtgctttcattgctccgtgcctgcgttctgtttttatataattcattagatattttatggtgttatttatattatttgtatgatatttgattagattgttcctactataatatgatattttctctggtattacttggattgcctcatatttcatgatgttttttctaaaaaattg

SEQ ID NO: 904 - DNA, 200 bp, Digitaria sanguinalis
agggcaatttccagcccttgtgccgatgaggtggctttaggtacgagcgtgattgaataaaaaaaacattttaaaaataatttcggctcctttttgggctatccccagacatgggaaaagttttcaaatttcttttacccctccctctgtgctcggaactcataatcaaatcaaccacttccggagataaagctgcctgt

SEQ ID NO: 905 - DNA, 200 bp, Digitaria sanguinalis
acaggcagctttatctccggaagtggttgatttgattatgagttccgagcacagagggaggggtaaaagaaatttgaaaacttttcccatgtctggggatagcccaaaaaggagccgaaattatttttaaaatgttttttttattcaatcacgctcgtacctaaagccacctcatcggcacaagggctggaaattgccct

SEQ ID NO: 906 - DNA, 200 bp, Digitaria sanguinalis
cacttccggagataaagctgcctgtgcgcaattcaatattttcccacaccaactactgcacgtcctgatccacgtctcactgacaggctgcccccaattggttggtcccgcttgtcagcgacgaggctgagcgatctcctggtacgggatggtcctacttgtcagcgacgaggtgagcgatcttctgtacggggtggtcc

SEQ ID NO: 907 - DNA, 200 bp, Digitaria sanguinalis
ggaccaccccgtacagaagatcgctcacctcgtcgctgacaagtaggaccatcccgtaccaggagatcgctcagcctcgtcgctgacaagcgggaccaaccaattgggggcagcctgtcagtgagacgtggatcaggacgtgcagtagttggtgtgggaaaatattgaattgcgcacaggcagctttatctccggaagtg

SEQ ID NO: 908 - DNA, 200 bp, Digitaria sanguinalis
agcgatcttctgtacggggtggtccctccccgcacctaccgcgtcgaagaaataatcgaatagaatatacgcggaactcgaaaggtaagattttgcagcggtatttgtacgtgtatggcgtatagtatacgtattttgttgggatcaagggctggaagcttgacgccaacttgtttccatcccttgggtcgtcgccatta

SEQ ID NO: 909 - DNA, 200 bp, Digitaria sanguinalis
taatggcgacgacccaagggatggaaacaagttggcgtcaagcttccagcccttgatcccaacaaaatacgtatactatacgccatacacgtacaaataccgctgcaaaatcttacctttcgagttccgcgtatattctattcgattatttcttcgacgcggtaggtgcggggagggaccaccccgtacagaagatcgct

SEQ ID NO: 910 - DNA, 200 bp, Digitaria sanguinalis
tccatcccttgggtcgtcgccattatatagccgccctcctctccaccgatctctaatccagcaccacatcctcctcttcttcctccgcctcccaagcctgcccgtgccaccgccagccgccggccatggcctgcctcaccgacctcgtcaacctcaacctctccgacaccaccgagaagatcatcgccgagtacatatgg

SEQ ID NO: 911 - DNA, 200 bp, Digitaria sanguinalis
ccatatgtactcggcgatgatcttctcggtggtgtcggagaggttgaggttgacgaggtcggtgaggcaggccatggccggcggctggcggtggcacgggcaggcttgggaggcggaggaagaagaggaggatgtggtgctggattagagatcggtggagaggagggcggctatataatggcgacgacccaagggatgga

SEQ ID NO: 912 - DNA, 200 bp, Digitaria sanguinalis
gaagatcatcgccgagtacatatggtacgtcacgtctcctactccttgttaagcgtccgtcagagagaatcgatcttgctggccgccggctgcctttcatggcgtctcggcggccggaaacgggctctggtcgaccgtcgcgtgtaaacgaaagatctttgggggcgtttggggagggtttttgggggagacggaggttt

SEQ ID NO: 913 - DNA, 200 bp, Digitaria sanguinalis
aaacctccgtctcccccaaaaaccctccccaaacgcccccaaagatctttcgtttacacgcgacggtcgaccagagcccgtttccggccgccgagacgccatgaaaggcagccggcggccagcaagatcgattctctctgacggacgcttaacaaggagtaggagacgtgacgtaccatatgtactcggcgatgatcttc

SEQ ID NO: 914 - DNA, 200 bp, Digitaria sanguinalis
gggtttttgggggagacggaggtttctcgtagattgttgcggatttgcctcccttttcgtcttcaccggctgaagcggcggcggtattagttccccccttctcctctgccagacaccagagcctgccaccctgtgcaacttctctgttttctcttggtggtgatcaattaattggttgtctgctcaatcttcatgtaaaa

SEQ ID NO: 915 - DNA, 200 bp, Digitaria sanguinalis
ttttacatgaagattgagcagacaaccaattaattgatcaccaccaagagaaaacagagaagttgcacagggtggcaggctctggtgtctggcagaggagaaggggggaactaataccgccgccgcttcagccggtgaagacgaaaagggaggcaaatccgcaacaatctacgagaaacctccgtctcccccaaaaaccc

SEQ ID NO: 916 - DNA, 200 bp, Digitaria sanguinalis
ttgtctgctcaatcttcatgtaaaaaaaaaatcaaactgttttttcttttatttttttgccggtttattctcccatgaatatttgacttcagttggggatatgcttcaagagagatgcagtcgaaactcgaagtacttgatgtacgtctcttgttcctcctgttgggggaggatatctgaagcggcagtcgctgctggcc

SEQ ID NO: 917 - DNA, 200 bp, Digitaria sanguinalis
ggccagcagcgactgccgcttcagatatcctcccccaacaggaggaacaagagacgtacatcaagtacttcgagtttcgactgcatctctcttgaagcatatccccaactgaagtcaaatattcatgggagaataaaccggcaaaaaaataaaagaaaaaacagtttgattttttttttacatgaagattgagcagacaa

SEQ ID NO: 918 - DNA, 200 bp, Digitaria sanguinalis
tctgaagcggcagtcgctgctggccaactggttggtccctcacgacaccgcgacggccagatgatctgttggcacagtaatcctatgtttatgtgttaatttatccccctgatgccctcaaatagattgctcttctccgatgaacatggcgtggagttgttcggtttgttggtgatttgaccctatcttaatgcatggct

SEQ ID NO: 919 - DNA, 200 bp, Digitaria sanguinalis
agccatgcattaagatagggtcaaatcaccaacaaaccgaacaactccacgccatgttcatcggagaagagcaatctatttgagggcatcagggggataaattaacacataaacataggattactgtgccaacagatcatctggccgtcgcggtgtcgtgagggaccaaccagttggccagcagcgactgccgcttcaga

SEQ ID NO: 920 - DNA, 200 bp, Digitaria sanguinalis
tttgaccctatcttaatgcatggctccttttctgttacaggatcggtggatctggcatggatctcaggagcaaggccagggtaagatgataaagattcccacgcttggactggaatactgtttgctgtgactcatcacttatctctgaagtcatcctctgagctgttctttggcttatatatcggatctcagctggctgc

SEQ ID NO: 921 - DNA, 200 bp, Digitaria sanguinalis
gcagccagctgagatccgatatataagccaaagaacagctcagaggatgacttcagagataagtgatgagtcacagcaaacagtattccagtccaagcgtgggaatctttatcatcttaccctggccttgctcctgagatccatgccagatccaccgatcctgtaacagaaaaggagccatgcattaagatagggtcaaa

SEQ ID NO: 922 - DNA, 200 bp, Digitaria sanguinalis
tatatatcggatctcagctggctgccatgctgctttcctttttattttttcttaaaactagaaagatcttttttaaacattaaaattcatatcgatctggttggtgcttcgcagaccctccccgggccggtgaccgatcccagcaagctgcctaagtggaactacgatggctccagtaccggccaggcccccggtgagga

SEQ ID NO: 923 - DNA, 200 bp, Digitaria sanguinalis
tcctcaccgggggcctggccggtactggagccatcgtagttccacttaggcagcttgctgggatcggtcaccggcccggggagggtctgcgaagcaccaaccagatcgatatgaattttaatgtttaaaaaagatctttctagttttaagaaaaaataaaaaggaaagcagcatggcagccagctgagatccgatatata

SEQ ID NO: 924 - DNA, 200 bp, Digitaria sanguinalis
gtaccggccaggcccccggtgaggacagtgaggtcatcctgtagtaagtatcatggcatgccatcccttcgcttttgttctattgctagcaaaaaaggaatgatccttatctcttgtgcatgtgccatcctgcagcccgcaggctatcttcaaggacccattcaggaagggcaacaacatccttgtgagtttccactttt

SEQ ID NO: 925 - DNA, 200 bp, Digitaria sanguinalis
aaaagtggaaactcacaaggatgttgttgcccttcctgaatgggtccttgaagatagcctgcgggctgcaggatggcacatgcacaagagataaggatcattccttttttgctagcaatagaacaaaagcgaagggatggcatgccatgatacttactacaggatgacctcactgtcctcaccgggggcctggccggtac

SEQ ID NO: 926 - DNA, 200 bp, Digitaria sanguinalis
aacatccttgtgagtttccacttttaacatccaagggatctgaatcatatgttactattgtcatacagctacagttaaattgatacaactcaatcagtccacccctgtgaaaaaagtttgtcttgttactaattacagtaggtataaattatgtttttagtttttaatctgcctgctgtataggtcaaattatggtaatg

SEQ ID NO: 927 - DNA, 200 bp, Digitaria sanguinalis
cattaccataatttgacctatacagcaggcagattaaaaactaaaaacataatttatacctactgtaattagtaacaagacaaacttttttcacaggggtggactgattgagttgtatcaatttaactgtagctgtatgacaatagtaacatatgattcagatcccttggatgttaaaagtggaaactcacaaggatgtt

SEQ ID NO: 928 - DNA, 200 bp, Digitaria sanguinalis
ctgtataggtcaaattatggtaatgcagcactaaagattcctaatgcaggttctcaactctgaatctctgtctagttagcagaattgcaaattatataacatgctgacctggtgacatgagcttagatattttttgaactaaaagtctgattgtccagtgtacctaaccataggtttaggaatctgatcggttgttttgt

SEQ ID NO: 929 - DNA, 200 bp, Digitaria sanguinalis
acaaaacaaccgatcagattcctaaacctatggttaggtacactggacaatcagacttttagttcaaaaaatatctaagctcatgtcaccaggtcagcatgttatataatttgcaattctgctaactagacagagattcagagttgagaacctgcattaggaatctttagtgctgcattaccataatttgacctatacag

SEQ ID NO: 930 - DNA, 200 bp, Digitaria sanguinalis
ttaggaatctgatcggttgttttgtcaacctctaataatagggaccatttttgggcattcaatgaattcgtttgacccgcaggtcatgtgcgattgctacaccccagctggtgagccaattcccaccaacaagaggcacaatgctgccaagatcttcagcagccctgaggtcgctgctgaggagccctggtacgcaaatc

SEQ ID NO: 931 - DNA, 200 bp, Digitaria sanguinalis
gatttgcgtaccagggctcctcagcagcgacctcagggctgctgaagatcttggcagcattgtgcctcttgttggtgggaattggctcaccagctggggtgtagcaatcgcacatgacctgcgggtcaaacgaattcattgaatgcccaaaaatggtccctattattagaggttgacaaaacaaccgatcagattcctaa

SEQ ID NO: 932 - DNA, 200 bp, Digitaria sanguinalis
gctgaggagccctggtacgcaaatctttactgaataactatgataaaaggcgaaacaatcaatatatttacaaaattgaccatgattgttttgccaatggcaggtatggtattgagcaggagtacaccctcctccagaaggacatcaactggccccttgggtggcctgttggtggcttccctggccctcaggtagacgat

SEQ ID NO: 933 - DNA, 200 bp, Digitaria sanguinalis
atcgtctacctgagggccagggaagccaccaacaggccacccaaggggccagttgatgtccttctggaggagggtgtactcctgctcaataccatacctgccattggcaaaacaatcatggtcaattttgtaaatatattgattgtttcgccttttatcatagttattcagtaaagatttgcgtaccagggctcctcagc

SEQ ID NO: 934 - DNA, 200 bp, Digitaria sanguinalis
cttccctggccctcaggtagacgatcacttcattagttggcttgcttaagattttattcattgattcggtcctacattggttggagtgtcccttgacagatttcaattatcttttagggtccttactactgtagtattggtgcggacaagtcgtttgggcgtgacatagttgactcccactacaaggcttgcctgtatgc

SEQ ID NO: 935 - DNA, 200 bp, Digitaria sanguinalis
gcatacaggcaagccttgtagtgggagtcaactatgtcacgcccaaacgacttgtccgcaccaatactacagtagtaaggaccctaaaagataattgaaatctgtcaagggacactccaaccaatgtaggaccgaatcaatgaataaaatcttaagcaagccaactaatgaagtgatcgtctacctgagggccagggaag

SEQ ID NO: 936 - DNA, 200 bp, Digitaria sanguinalis
cccactacaaggcttgcctgtatgctggcatcaacatcagtggcatcaacggggaggtcatgccaggacaggtgaaattttactagacttggcaacctgttttgtaccctgaagttaacatctttctgaccatggtaaaaatgctgtggttggtttcagtgggagttccaagttggcccgtccgttggcatttctgccgg

SEQ ID NO: 937 - DNA, 200 bp, Digitaria sanguinalis
ccggcagaaatgccaacggacgggccaacttggaactcccactgaaaccaaccacagcatttttaccatggtcagaaagatgttaacttcagggtacaaaacaggttgccaagtctagtaaaatttcacctgtcctggcatgacctccccgttgatgccactgatgttgatgccagcatacaggcaagccttgtagtggg

SEQ ID NO: 938 - DNA, 200 bp, Digitaria sanguinalis
gcccgtccgttggcatttctgccggtgaccaggtgtgggttgctcgctacattcttgaggtatggatccaacttctggaatctatatgtgatcaaatataacacgatcttcttgaaccaaacaagatttgcagcacttgagctaatctgtccctttttcaacagaggatcactgagatcgccggtgtggttgtgtcattc

SEQ ID NO: 939 - DNA, 200 bp, Digitaria sanguinalis
gaatgacacaaccacaccggcgatctcagtgatcctctgttgaaaaagggacagattagctcaagtgctgcaaatcttgtttggttcaagaagatcgtgttatatttgatcacatatagattccagaagttggatccatacctcaagaatgtagcgagcaacccacacctggtcaccggcagaaatgccaacggacgggc

SEQ ID NO: 940 - DNA, 200 bp, Digitaria sanguinalis
gatcgccggtgtggttgtgtcattcgaccccaagcccatcccgggagactggaacggtgctggtgctcacaccaactacagcaccaagtccatgaggaacgatggcgggtacgaggtgatcaagtccgcgatcgagaagctgaagctgcgccacaaggagcacatcgccgcctatggcgagggcaacgagcgccggctga

SEQ ID NO: 941 - DNA, 200 bp, Digitaria sanguinalis
tcagccggcgctcgttgccctcgccataggcggcgatgtgctccttgtggcgcagcttcagcttctcgatcgcggacttgatcacctcgtacccgccatcgttcctcatggacttggtgctgtagttggtgtgagcaccagcaccgttccagtctcccgggatgggcttggggtcgaatgacacaaccacaccggcgatc

SEQ ID NO: 942 - DNA, 200 bp, Digitaria sanguinalis
ggcgagggcaacgagcgccggctgaccggcaggcacgagaccgccgacatcaacaccttcagctgggtacgtcgtcccccattgtggacttggattccccaatccgtggaaagggagattcgtgtgccaactctgtttgttctgtctcttgcagggagtcgccaaccgtggcgcgtctgtgcgcgtgggcagggagacgg

SEQ ID NO: 943 - DNA, 200 bp, Digitaria sanguinalis
ccgtctccctgcccacgcgcacagacgcgccacggttggcgactccctgcaagagacagaacaaacagagttggcacacgaatctccctttccacggattggggaatccaagtccacaatgggggacgacgtacccagctgaaggtgttgatgtcggcggtctcgtgcctgccggtcagccggcgctcgttgccctcgcc

SEQ ID NO: 944 - DNA, 200 bp, Digitaria sanguinalis
tctgtgcgcgtgggcagggagacggagcagaatggcaagggctacttcgaggaccgccggccggcgtccaacatggacccctacgtggtgacctccatgatcgccgagaccaccatcgtctggaagccctgattcgtcccctctccagctccccgtctcgtgtcaactgcttctgcttcgggcggtggcggccatggcta

SEQ ID NO: 945 - DNA, 200 bp, Digitaria sanguinalis
tagccatggccgccaccgcccgaagcagaagcagttgacacgagacggggagctggagaggggacgaatcagggcttccagacgatggtggtctcggcgatcatggaggtcaccacgtaggggtccatgttggacgccggccggcggtcctcgaagtagcccttgccattctgctccgtctccctgcccacgcgcacaga

SEQ ID NO: 946 - DNA, 200 bp, Digitaria sanguinalis
cttcgggcggtggcggccatggctactacctctggcgattgcgttgaactgggcacaacaaatgtccgatgattccgttccattccgtctggttatactattggcatttagttagatccatgtcgagggttgtgcgaaaacaaaacagaacaaaaaccattgtttgctttgatgctttccacttcccatgccttccgttt

SEQ ID NO: 947 - DNA, 200 bp, Digitaria sanguinalis
aaacggaaggcatgggaagtggaaagcatcaaagcaaacaatggtttttgttctgttttgttttcgcacaaccctcgacatggatctaactaaatgccaatagtataaccagacggaatggaacggaatcatcggacatttgttgtgcccagttcaacgcaatcgccagaggtagtagccatggccgccaccgcccgaag

SEQ ID NO: 948 - DNA, 200 bp, Digitaria sanguinalis
tttccacttcccatgccttccgtttgggtggtcacttgtgtaatcctccaataatgaccgtaccgcagcggtggtaccttcagtacttgcatcactagtgctagccctctttttttttttctacatgtgcattgtgagtgacagtgagtgggtgggtgtaaattgtatcacaaaagtggcttgctttgctgcacctccaa

SEQ ID NO: 949 - DNA, 200 bp, Digitaria sanguinalis
ttggaggtgcagcaaagcaagccacttttgtgatacaatttacacccacccactcactgtcactcacaatgcacatgtagaaaaaaaaaaagagggctagcactagtgatgcaagtactgaaggtaccaccgctgcggtacggtcattattggaggattacacaagtgaccacccaaacggaaggcatgggaagtggaaa

SEQ ID NO: 950 - DNA, 200 bp, Digitaria sanguinalis
gtggcttgctttgctgcacctccaatggcaatggctttcttccggcgataaagaatcaatcatcatggctgtggcgagtgcgggcagtgcgtggccgcactgtggtcgccgattaaagtaatcctgttttaggtcagattcttgaacgggttacttgtcttttctccgaaaattcagcaccaccggccattgatcactca

SEQ ID NO: 951 - DNA, 200 bp, Digitaria sanguinalis
tgagtgatcaatggccggtggtgctgaattttcggagaaaagacaagtaacccgttcaagaatctgacctaaaacaggattactttaatcggcgaccacagtgcggccacgcactgcccgcactcgccacagccatgatgattgattctttatcgccggaagaaagccattgccattggaggtgcagcaaagcaagccac

SEQ ID NO: 952 - DNA, 200 bp, Digitaria sanguinalis
agcaccaccggccattgatcactcaggaatcttgatcggttggtggagggagggtcacggaagagctgaatgcttgtcatcttgcacggacggacaagtggggggcacgagaatccatcagagatcacacaacaacttcccagttagttccatgacgtatgggcccgctgctctgtggaccccgtatcccatctttgcag

SEQ ID NO: 953 - DNA, 200 bp, Digitaria sanguinalis
ctgcaaagatgggatacggggtccacagagcagcgggcccatacgtcatggaactaactgggaagttgttgtgtgatctctgatggattctcgtgccccccacttgtccgtccgtgcaagatgacaagcattcagctcttccgtgaccctccctccaccaaccgatcaagattcctgagtgatcaatggccggtggtgct

SEQ ID NO: 954 - DNA, 200 bp, Digitaria sanguinalis
tggaccccgtatcccatctttgcagcgagtatgggcccgctgctctgtggaccccgtatcccatctttgcagcgagaccgcgtcccgtgcagttagcgctgcaacagccaacgcgcgtcagctccagccctagccggcaccagcccagccaaccgaatcttcctctcatcacacagacacagcaactactagatgttgct

SEQ ID NO: 955 - DNA, 200 bp, Digitaria sanguinalis
agcaacatctagtagttgctgtgtctgtgtgatgagaggaagattcggttggctgggctggtgccggctagggctggagctgacgcgcgttggctgttgcagcgctaactgcacgggacgcggtctcgctgcaaagatgggatacggggtccacagagcagcgggcccatactcgctgcaaagatgggatacggggtcca

SEQ ID NO: 956 - DNA, 200 bp, Digitaria sanguinalis
gacacagcaactactagatgttgctatccaatgactgttccacaacatggcccctcttctctcagttcgactggtccgatcggatcatctggtggagcagtactagcagcttgcagcgccagcaatccagcatgttatcgtctcgagctctcaacaacccaactactctcaaaaagagaggatggcccggccggcgttct

SEQ ID NO: 957 - DNA, 200 bp, Digitaria sanguinalis
agaacgccggccgggccatcctctctttttgagagtagttgggttgttgagagctcgagacgataacatgctggattgctggcgctgcaagctgctagtactgctccaccagatgatccgatcggaccagtcgaactgagagaagaggggccatgttgtggaacagtcattggatagcaacatctagtagttgctgtgtc

SEQ ID NO: 958 - DNA, 200 bp, Digitaria sanguinalis
gagaggatggcccggccggcgttcttgacgacgctgatttacaaagttgacccgcgggcacaagcacttttacacagcatcctcaccaactccggcgacattgtacgggcacatcttaaccgctcggcttgaaacggcgatgccatatgttttcttttctcgctaatccctgccaggtcaaagcttgacagtatctgggc

SEQ ID NO: 959 - DNA, 200 bp, Digitaria sanguinalis
gcccagatactgtcaagctttgacctggcagggattagcgagaaaagaaaacatatggcatcgccgtttcaagccgagcggttaagatgtgcccgtacaatgtcgccggagttggtgaggatgctgtgtaaaagtgcttgtgcccgcgggtcaactttgtaaatcagcgtcgtcaagaacgccggccgggccatcctctc

SEQ ID NO: 960 - DNA, 200 bp, Digitaria sanguinalis
ggtcaaagcttgacagtatctgggctacccacggcacactgaaagcctgaaacatccagtatcttcatcctcgcacgtctcgccgccgggctttctttatgagaaaatccagcgtctctactcccaactacaattttgttcgttgccgagtcaaagcataccgtgcaggttggttccagtagaacagtggcccaaaggca

SEQ ID NO: 961 - DNA, 200 bp, Digitaria sanguinalis
tgcctttgggccactgttctactggaaccaacctgcacggtatgctttgactcggcaacgaacaaaattgtagttgggagtagagacgctggattttctcataaagaaagcccggcggcgagacgtgcgaggatgaagatactggatgtttcaggctttcagtgtgccgtgggtagcccagatactgtcaagctttgacc

SEQ ID NO: 962 - DNA, 200 bp, Digitaria sanguinalis
ccagtagaacagtggcccaaaggcacggctaaggtcagccatccttttgcggctggaaagggctgattggccggcactatctgtcacccacggaaggatggacggagaaggaaacacatcagcaggccgaggcgccacttcgtgctaccaaaagctactcgtggctctctgtcttgtagccatggattacaggattagag

SEQ ID NO: 963 - DNA, 200 bp, Digitaria sanguinalis
ctctaatcctgtaatccatggctacaagacagagagccacgagtagcttttggtagcacgaagtggcgcctcggcctgctgatgtgtttccttctccgtccatccttccgtgggtgacagatagtgccggccaatcagccctttccagccgcaaaaggatggctgaccttagccgtgcctttgggccactgttctactgg

SEQ ID NO: 964 - DNA, 200 bp, Digitaria sanguinalis
gtagccatggattacaggattagagctctgatttcagcgtaaacaactctgtttccaaggaaagcattgtttagtacaatggcagcaaactgcggccctgatggtgagagaaactccggcggaagcgacagaaacatggtgcaagctaatcagatgcttcagataggtataattatccatgacactgccagatgttgctc

SEQ ID NO: 965 - DNA, 200 bp, Digitaria sanguinalis
gagcaacatctggcagtgtcatggataattatacctatctgaagcatctgattagcttgcaccatgtttctgtcgcttccgccggagtttctctcaccatcagggccgcagtttgctgccattgtactaaacaatgctttccttggaaacagagttgtttacgctgaaatcagagctctaatcctgtaatccatggctac

SEQ ID NO: 966 - DNA, 200 bp, Digitaria sanguinalis
tccatgacactgccagatgttgctcgatttcaatttcttttaggaagaatgttcaatacacctatattctgctgctgctgctgatctgggcaagaaacctgagcgatagatgtgcgcatatcatttgtcatgcgctgagtactgacagatgaccgtgcaatttggaatcctggctagcggtcatatttgcgcacgaaatg

SEQ ID NO: 967 - DNA, 200 bp, Digitaria sanguinalis
catttcgtgcgcaaatatgaccgctagccaggattccaaattgcacggtcatctgtcagtactcagcgcatgacaaatgatatgcgcacatctatcgctcaggtttcttgcccagatcagcagcagcagcagaatataggtgtattgaacattcttcctaaaagaaattgaaatcgagcaacatctggcagtgtcatgga

SEQ ID NO: 968 - DNA, 200 bp, Digitaria sanguinalis
agcggtcatatttgcgcacgaaatgatattgggtaaggatttatcttttatgaatggacacaaacacacaagtactagcggtggaggtggatttggattatcaacactatagttgaccttttttctttcaaatttattggattgcatctatatttggattttggatatattggattggatctatatttggattttggata

SEQ ID NO: 969 - DNA, 200 bp, Digitaria sanguinalis
tatccaaaatccaaatatagatccaatccaatatatccaaaatccaaatatagatgcaatccaataaatttgaaagaaaaaaggtcaactatagtgttgataatccaaatccacctccaccgctagtacttgtgtgtttgtgtccattcataaaagataaatccttacccaatatcatttcgtgcgcaaatatgaccgct

SEQ ID NO: 970 - DNA, 200 bp, Digitaria sanguinalis
tggatctatatttggattttggatatatgtggattacgaagttcacacttgatatggacatggaagcaaagcttgctggccgagtgtggcaagaaagctgagcgacggatagatgggagcacatcacttgccatgtactgacaaatgaccgtgcaatttggaatcctgggtagaggtcatttttgcgcacggaatgatat

SEQ ID NO: 971 - DNA, 200 bp, Digitaria sanguinalis
atatcattccgtgcgcaaaaatgacctctacccaggattccaaattgcacggtcatttgtcagtacatggcaagtgatgtgctcccatctatccgtcgctcagctttcttgccacactcggccagcaagctttgcttccatgtccatatcaagtgtgaacttcgtaatccacatatatccaaaatccaaatatagatcca

SEQ ID NO: 972 - DNA, 200 bp, Digitaria sanguinalis
gtcatttttgcgcacggaatgatattgggaaagcatttattttctatggacggacacaaacacacaagtatacacaggcacgtcaaaaatccatgtgtgacgatcttgtgctcaagatcaatcattcaaggttgagccatcagcacgaatggaccaaatggcattggaatctgaggctgctgtcaacaaacaattattga

SEQ ID NO: 973 - DNA, 200 bp, Digitaria sanguinalis
tcaataattgtttgttgacagcagcctcagattccaatgccatttggtccattcgtgctgatggctcaaccttgaatgattgatcttgagcacaagatcgtcacacatggatttttgacgtgcctgtgtatacttgtgtgtttgtgtccgtccatagaaaataaatgctttcccaatatcattccgtgcgcaaaaatgac

SEQ ID NO: 974 - DNA, 200 bp, Euphorbia heterophylla
aaaaatatttgcactattaaagtttcaaatttttttatgacttttatttcatatgtgattatgcttgttctgcttcgtaaaatgtcgactttttcgttgtcacacagtgggagtatcaagtcggtccaagtgtgggaattgaggctggcgatcacatttggtgttcaagatacattcttgaggtattattaattttattt

SEQ ID NO: 975 - DNA, 200 bp, Euphorbia heterophylla
aaataaaattaataatacctcaagaatgtatcttgaacaccaaatgtgatcgccagcctcaattcccacacttggaccgacttgatactcccactgtgtgacaacgaaaaagtcgacattttacgaagcagaacaagcataatcacatatgaaataaaagtcataaaaaaatttgaaactttaatagtgcaaatattttt

SEQ ID NO: 976 - DNA, 200 bp, Euphorbia heterophylla
tcttgaggtattattaattttattttaccgagtctcatctatcaagtcggtccaagtttgtgaattaatttcgaagaaaggcggtctatgttttagtttcggataaataccgtttcaataatcaccttttatgacagagaatcaccgaacaagctggagttgttctcacactggaccccaagccgatcgaggtgattccg

SEQ ID NO: 977 - DNA, 200 bp, Euphorbia heterophylla
cggaatcacctcgatcggcttggggtccagtgtgagaacaactccagcttgttcggtgattctctgtcataaaaggtgattattgaaacggtatttatccgaaactaaaacatagaccgcctttcttcgaaattaattcacaaacttggaccgacttgatagatgagactcggtaaaataaaattaataatacctcaaga

SEQ ID NO: 978 - DNA, 200 bp, Euphorbia heterophylla
ccccaagccgatcgaggtgattccgactcacatcttcatattgctttttcttgttttagaaaataaaaaaaatcaacttaaatcgaacttgtttttcgatagggtgattggaatggtgctgggtgtcacactaattacaggtaacttaatgttaatcgatctcgattttgaactcttttttagtttttccatcgaaaata

SEQ ID NO: 979 - DNA, 200 bp, Euphorbia heterophylla
tattttcgatggaaaaactaaaaaagagttcaaaatcgagatcgattaacattaagttacctgtaattagtgtgacacccagcaccattccaatcaccctatcgaaaaacaagttcgatttaagttgattttttttattttctaaaacaagaaaaagcaatatgaagatgtgagtcggaatcacctcgatcggcttgggg

SEQ ID NO: 980 - DNA, 200 bp, Euphorbia heterophylla
ttttttagtttttccatcgaaaataacaagaaatttcgatttttttaaacccgtatctttcagtacaaaaagtatgagagaagaaggtggatttgaagtgataaagaaagcgattttgaacctctcacttcgccataaggatcacattagtgcctatggtgaaggaaatgagagaaggttgaccggaaaacacgaaaccg

SEQ ID NO: 981 - DNA, 200 bp, Euphorbia heterophylla
cggtttcgtgttttccggtcaaccttctctcatttccttcaccataggcactaatgtgatccttatggcgaagtgagaggttcaaaatcgctttctttatcacttcaaatccaccttcttctctcatactttttgtactgaaagatacgggtttaaaaaaatcgaaatttcttgttattttcgatggaaaaactaaaaaa

SEQ ID NO: 982 - DNA, 200 bp, Euphorbia heterophylla
aggttgaccggaaaacacgaaaccgccagcattgactcgttttcttgggtaagcctaaaaacgaaactttatccgaaacaaataaaaagacgacgacttttcgtagctaatttggttctaatcatgattcatcgaaatttgattttagggagtggcaaatcgtggatgctcgattcgagtaggtcgtgatactgagaaga

SEQ ID NO: 983 - DNA, 200 bp, Euphorbia heterophylla
tcttctcagtatcacgacctactcgaatcgagcatccacgatttgccactccctaaaatcaaatttcgatgaatcatgattagaaccaaattagctacgaaaagtcgtcgtctttttatttgtttcggataaagtttcgtttttaggcttacccaagaaaacgagtcaatgctggcggtttcgtgttttccggtcaacct

SEQ ID NO: 984 - DNA, 200 bp, Euphorbia heterophylla
cgagtaggtcgtgatactgagaagaacggcaaaggtattctatcttaggggtgagcaaatgtcagtttgaaaaccgaaccgaaaaccgaatagagaaaaggagtgaaccgaatacagaaccaaattaatttcggttcagttcaaactgaaccgaattatttcggttcgattcgttttggttttgaaccaaataaattttt

SEQ ID NO: 985 - DNA, 200 bp, Euphorbia heterophylla
aaaaatttatttggttcaaaaccaaaacgaatcgaaccgaaataattcggttcagtttgaactgaaccgaaattaatttggttctgtattcggttcactccttttctctattcggttttcggttcggttttcaaactgacatttgctcacccctaagatagaatacctttgccgttcttctcagtatcacgacctactcg

SEQ ID NO: 986 - DNA, 200 bp, Euphorbia heterophylla
ttggttttgaaccaaataaatttttcgttaactttatatttttaaatatacatttaaatatataaaatgacaaaaaaatcaacatagttatctttgaacacaaatacattattgttaatttgaaaagaataactttattttcaagtataaaatgtaaattgaactaaaaacataaataaattaaacatgaaaaaaataaa

SEQ ID NO: 987 - DNA, 200 bp, Euphorbia heterophylla
tttatttttttcatgtttaatttatttatgtttttagttcaatttacattttatacttgaaaataaagttattcttttcaaattaacaataatgtatttgtgttcaaagataactatgttgatttttttgtcattttatatatttaaatgtatatttaaaaatataaagttaacgaaaaatttatttggttcaaaaccaa

SEQ ID NO: 988 - DNA, 200 bp, Euphorbia heterophylla
ataaattaaacatgaaaaaaataaaaaaaatccaattcggttcggttttcggttttttcaggttatgaccataaaaaccgaaccgaataagttcggttcggtttcttggtttggttcggtttccgatttttttgctctcccctagtctatctcgaggaaatttgattgaatttctcaaatggaaattctcgatattttgc

SEQ ID NO: 989 - DNA, 200 bp, Euphorbia heterophylla
gcaaaatatcgagaatttccatttgagaaattcaatcaaatttcctcgagatagactaggggagagcaaaaaaatcggaaaccgaaccaaaccaagaaaccgaaccgaacttattcggttcggtttttatggtcataacctgaaaaaaccgaaaaccgaaccgaattggattttttttatttttttcatgtttaatttat

SEQ ID NO: 990 - DNA, 200 bp, Euphorbia heterophylla
caaatggaaattctcgatattttgctgacctggcgcgtaattcttcggttttttaggttacttggaagacagaagacccgcgtcgaacatggacccttatgtggtgacctcgttactagccgagactacgcttttatgggagccaactttggaggctgaagctcttgcagcccaaaaattatccttgaaagtataatcga

SEQ ID NO: 991 - DNA, 200 bp, Euphorbia heterophylla
tcgattatactttcaaggataatttttgggctgcaagagcttcagcctccaaagttggctcccataaaagcgtagtctcggctagtaacgaggtcaccacataagggtccatgttcgacgcgggtcttctgtcttccaagtaacctaaaaaaccgaagaattacgcgccaggtcagcaaaatatcgagaatttccatttg

SEQ ID NO: 992 - DNA, 200 bp, Euphorbia heterophylla
aaattatccttgaaagtataatcgactcggttcgagaaattctcgagctttcgggaattagtaatttcgttaaagttcgcgtctttgggaaaaatcatttgtaaataaaggttccgatgcgagtaatttctttttcttgtaaaatggtctataactgatgtttgacatcaaaaggaccactttttttttttttttttact

SEQ ID NO: 993 - DNA, 200 bp, Euphorbia heterophylla
agtaaaaaaaaaaaaaaaaagtggtccttttgatgtcaaacatcagttatagaccattttacaagaaaaagaaattactcgcatcggaacctttatttacaaatgatttttcccaaagacgcgaactttaacgaaattactaattcccgaaagctcgagaatttctcgaaccgagtcgattatactttcaaggataattt

SEQ ID NO: 994 - DNA, 200 bp, Euphorbia heterophylla
accactttttttttttttttttacttttgactagtcgagaacccgagtaattttttgttgtttgaagcatcggcgcctttgactatgatttgattatataacatttctgttcttgatttaattgcatttaaaatataataattcgaggcctctcggaagtttggaaatcaggttttcggtataaacccaggaagccgaaa

SEQ ID NO: 995 - DNA, 200 bp, Euphorbia heterophylla
tttcggcttcctgggtttataccgaaaacctgatttccaaacttccgagaggcctcgaattattatattttaaatgcaattaaatcaagaacagaaatgttatataatcaaatcatagtcaaaggcgccgatgcttcaaacaacaaaaaattactcgggttctcgactagtcaaaagtaaaaaaaaaaaaaaaaagtggt

SEQ ID NO: 996 - DNA, 200 bp, Euphorbia heterophylla
tcggtataaacccaggaagccgaaaaagcttgtggcacactaaaggagagataaagtgaacaaagataaaattacaggtattagtataactttattccatttgtctgcaaaagacgaaaacttgtaaactatgcaagaatcaatttcgattctttgccctcaaaagaccgaaacatttctttcgttttaagatagtatgt

SEQ ID NO: 997 - DNA, 200 bp, Euphorbia heterophylla
acatactatcttaaaacgaaagaaatgtttcggtcttttgagggcaaagaatcgaaattgattcttgcatagtttacaagttttcgtcttttgcagacaaatggaataaagttatactaatacctgtaattttatctttgttcactttatctctcctttagtgtgccacaagctttttcggcttcctgggtttataccga

SEQ ID NO: 998 - DNA, 200 bp, Euphorbia heterophylla
tttctttcgttttaagatagtatgttctaaaacaaaaaatattcgttaaaaaaactctgctttgcatttatataactctactctaacctcagcaaaggccaaaaaggcaaaaaaacattgaaatttctcggctttccaaggcgaaaaaaccgatcaaatggcatccggatcatcgaaatcggtagccttattgctttcga

SEQ ID NO: 999 - DNA, 200 bp, Euphorbia heterophylla
tcgaaagcaataaggctaccgatttcgatgatccggatgccatttgatcggttttttcgccttggaaagccgagaaatttcaatgtttttttgcctttttggcctttgctgaggttagagtagagttatataaatgcaaagcagagtttttttaacgaatattttttgttttagaacatactatcttaaaacgaaagaaa

SEQ ID NO: 1000 - DNA, 200 bp, Euphorbia heterophylla
aaatcggtagccttattgctttcgatagtcaacattgccctctacttcatcattatagtaattgcttcatgggctataaacaaagcaattcaccgaactcacgaaaccggtaaatattttaattttaagttaattctaaatttaatttagttttactatactaatcataattttttaattcagtttcggttttgtcaatc

SEQ ID NO: 1001 - DNA, 200 bp, Euphorbia heterophylla
gattgacaaaaccgaaactgaattaaaaaattatgattagtatagtaaaactaaattaaatttagaattaacttaaaattaaaatatttaccggtttcgtgagttcggtgaattgctttgtttatagcccatgaagcaattactataatgatgaagtagagggcaatgttgactatcgaaagcaataaggctaccgattt

SEQ ID NO: 1002 - DNA, 200 bp, Euphorbia heterophylla
taattcagtttcggttttgtcaatcccggctcgaattttccccatattttttccgatgggaaatatggcaaccgggtttttcatcatatattccctactcgccggagttgtgggaatcgcttcctcactcaccggaattcaaaatttatcgaaaccgagtgtctcgagtctacatgccgctgcggcgatttctatgactg

SEQ ID NO: 1003 - DNA, 200 bp, Euphorbia heterophylla
cagtcatagaaatcgccgcagcggcatgtagactcgagacactcggtttcgataaattttgaattccggtgagtgaggaagcgattcccacaactccggcgagtagggaatatatgatgaaaaacccggttgccatatttcccatcggaaaaaatatggggaaaattcgagccgggattgacaaaaccgaaactgaatta

SEQ ID NO: 1004 - DNA, 200 bp, Euphorbia heterophylla
gccgctgcggcgatttctatgactgccctttcacttactttactagccatggggtagtttttgaaaaattcgttacttatttatgcttatttgtgtttcctatgaacataaagttttgaacttttttttttcgggattttgtttcgtagactggcgtgtaaggaaatacaacagggttggaccgattcgaacctgaggac

SEQ ID NO: 1005 - DNA, 200 bp, Euphorbia heterophylla
gtcctcaggttcgaatcggtccaaccctgttgtatttccttacacgccagtctacgaaacaaaatcccgaaaaaaaaaagttcaaaactttatgttcataggaaacacaaataagcataaataagtaacgaatttttcaaaaactaccccatggctagtaaagtaagtgaaagggcagtcatagaaatcgccgcagcggc

SEQ ID NO: 1006 - DNA, 200 bp, Euphorbia heterophylla
gttggaccgattcgaacctgaggactttggagattgtgacaatagttgtgagtggtacgcaattggtgagcaccggtgctatattttctgggattaattgaagatgttgcgttagaagaaaaccgagccgtgtggattgggagggtagctcgaaaagtttttcgaaactcggatttgaatttcgatttattctaactgga

SEQ ID NO: 1007 - DNA, 200 bp, Euphorbia heterophylla
tccagttagaataaatcgaaattcaaatccgagtttcgaaaaacttttcgagctaccctcccaatccacacggctcggttttcttctaacgcaacatcttcaattaatcccagaaaatatagcaccggtgctcaccaattgcgtaccactcacaactattgtcacaatctccaaagtcctcaggttcgaatcggtccaac

SEQ ID NO: 1008 - DNA, 200 bp, Euphorbia heterophylla
tgaatttcgatttattctaactggagttttcaagtacaaatgtatgtttgcgagttcagtttgaagtctttaagcatttgtttgaatttgcatgttggttgtgtaatttagttaatatttttacaatgttaataatgaacctagctatttcatatattctcttgacatggttaagagtataaatatgaatatatatttat

SEQ ID NO: 1009 - DNA, 200 bp, Euphorbia heterophylla
ataaatatatattcatatttatactcttaaccatgtcaagagaatatatgaaatagctaggttcattattaacattgtaaaaatattaactaaattacacaaccaacatgcaaattcaaacaaatgcttaaagacttcaaactgaactcgcaaacatacatttgtacttgaaaactccagttagaataaatcgaaattca

SEQ ID NO: 1010 - DNA, 200 bp, Euphorbia heterophylla
agtataaatatgaatatatatttatatatgaatatgaacctagttatgtagttaagaatttatatatattttataaacaaaacatttcaagttgttattatataaacctaacaacaaaaaaaagtaatagttaaattataatgataatattattaatatatactactttataaagctaactcgattacatttttaatcaa

SEQ ID NO: 1011 - DNA, 200 bp, Euphorbia heterophylla
ttgattaaaaatgtaatcgagttagctttataaagtagtatatattaataatattatcattataatttaactattacttttttttgttgttaggtttatataataacaacttgaaatgttttgtttataaaatatatataaattcttaactacataactaggttcatattcatatataaatatatattcatatttatact

SEQ ID NO: 1012 - DNA, 200 bp, Euphorbia heterophylla
ctaactcgattacatttttaatcaaaatttcgtattatatgaaattaaatatttaagacatattttaactaatccgtagcattattatttctctttcaaatcgaattattagttgaataaaaggaaaatttataatttatgattaaaatcaaactatttaaatacaaaagatcagacgatttttctcgaatgtatacctt

SEQ ID NO: 1013 - DNA, 200 bp, Euphorbia heterophylla
aaggtatacattcgagaaaaatcgtctgatcttttgtatttaaatagtttgattttaatcataaattataaattttccttttattcaactaataattcgatttgaaagagaaataataatgctacggattagttaaaatatgtcttaaatatttaatttcatataatacgaaattttgattaaaaatgtaatcgagttag

SEQ ID NO: 1014 - DNA, 200 bp, Euphorbia heterophylla
acgatttttctcgaatgtataccttaattgcaattttattagaattgaattggaccgaccaattgcactgatttgatttacggttgaactcgattttacaaataaaattataaactattatcttaatgtctagtccaatttcaataacatttgaactgaatttttcaagccgaatttatggttaaatttaaatcttataa

SEQ ID NO: 1015 - DNA, 200 bp, Euphorbia heterophylla
ttataagatttaaatttaaccataaattcggcttgaaaaattcagttcaaatgttattgaaattggactagacattaagataatagtttataattttatttgtaaaatcgagttcaaccgtaaatcaaatcagtgcaattggtcggtccaattcaattctaataaaattgcaattaaggtatacattcgagaaaaatcgt

SEQ ID NO: 1016 - DNA, 200 bp, Euphorbia heterophylla
aaaagttaatagagagtgagggatagctcaagtggttaaagcttccttctcgaggtgatcctgtgatcgattctcatcccgcccttgtatatatatataacagaggatctacaaatgattactctaactgcaacttatctcattttgcaactttcaataaactttagtactttccattaccttaactcctttagtgttat

SEQ ID NO: 1017 - DNA, 200 bp, Euphorbia heterophylla
ataacactaaaggagttaaggtaatggaaagtactaaagtttattgaaagttgcaaaatgagataagttgcagttagagtaatcatttgtagatcctctgttatatatatatacaagggcgggatgagaatcgatcacaggatcacctcgagaaggaagctttaaccacttgagctatccctcactctctattaactttt

SEQ ID NO: 1018 - DNA, 200 bp, Euphorbia heterophylla
attaccttaactcctttagtgttatggatttgttaacaaactccttgatttactttaacaagttaatttccctttaaacagagaattactgaacaagctggtgtagttttgactcttgatccaaagcccatcgaggtactaataacttttcttttgtattagtaatacgaatttttcatgtgttatccgtctgaaatctt

SEQ ID NO: 1019 - DNA, 200 bp, Euphorbia heterophylla
aagatttcagacggataacacatgaaaaattcgtattactaatacaaaagaaaagttattagtacctcgatgggctttggatcaagagtcaaaactacaccagcttgttcagtaattctctgtttaaagggaaattaacttgttaaagtaaatcaaggagtttgttaacaaatccataacactaaaggagttaaggtaat

SEQ ID NO: 1020 - DNA, 200 bp, Euphorbia heterophylla
aacaattaatcaatcatatttgcgtaactttttaataaggaatgtaggtatagatttcgagaaaatccaaagctcgatataagttttaattgtcactcaccacccaccttttttttgaaaatatataaattaaaacataaacggaattatcggttaatgaaatataattgtatatactaaccgaaaaaataattgtgaga

SEQ ID NO: 1021 - DNA, 200 bp, Euphorbia heterophylla
tctcacaattattttttcggttagtatatacaattatatttcattaaccgataattccgtttatgttttaatttatatattttcaaaaaaaaggtgggtggtgagtgacaattaaaacttatatcgagctttggattttctcgaaatctatacctacattccttattaaaaagttacgcaaatatgattgattaattgtt

SEQ ID NO: 1022 - DNA, 200 bp, Euphorbia heterophylla
actaaccgaaaaaataattgtgagatgagtaaataacttatattgtgttatttgatttttgcactttgtgtatgaatttgcgggtaataacaatttatttaatcaaatactatcgtttattttatgataaaaaatatacagatatttttaattttgtttattttgtctaaattatttattttgtctaaattaataccaca

SEQ ID NO: 1023 - DNA, 200 bp, Euphorbia heterophylla
tgtggtattaatttagacaaaataaataatttagacaaaataaacaaaattaaaaatatctgtatattttttatcataaaataaacgatagtatttgattaaataaattgttattacccgcaaattcatacacaaagtgcaaaaatcaaataacacaatataagttatttactcatctcacaattattttttcggttagt

SEQ ID NO: 1024 - DNA, 200 bp, Euphorbia heterophylla
ttattttgtctaaattaataccacagatcatttaattggcctcgctaaattatgaataaataatgatgaccaagtgtccaagtacacaagcttgttttcatcatagttgttggcttgttccaacttgcaattgtcgcttagcttatcccactacacaacaattgaaggctaaaaatgctcattagcttatgtcatgcacc

SEQ ID NO: 1025 - DNA, 200 bp, Euphorbia heterophylla
ggtgcatgacataagctaatgagcatttttagccttcaattgttgtgtagtgggataagctaagcgacaattgcaagttggaacaagccaacaactatgatgaaaacaagcttgtgtacttggacacttggtcatcattatttattcataatttagcgaggccaattaaatgatctgtggtattaatttagacaaaataa

SEQ ID NO: 1026 - DNA, 200 bp, Euphorbia heterophylla
tgctcattagcttatgtcatgcaccaaatatggggtcatgtgcaccatatgatgcactctatgcaaacataccctattcatttagtgcgcgttttttttcaccttattaaacccgaacttaaattcaaactaaacttaatgtttattaccccaatgtttcaggtatggcattgagcaagaatacacactccttcagaagg

SEQ ID NO: 1027 - DNA, 200 bp, Euphorbia heterophylla
ccttctgaaggagtgtgtattcttgctcaatgccatacctgaaacattggggtaataaacattaagtttagtttgaatttaagttcgggtttaataaggtgaaaaaaaacgcgcactaaatgaatagggtatgtttgcatagagtgcatcatatggtgcacatgaccccatatttggtgcatgacataagctaatgagca

SEQ ID NO: 1028 - DNA, 200 bp, Euphorbia heterophylla
caagaatacacactccttcagaaggaggtcaactggcctcttggttggccagttggtggcttccctggtcctcaggtgcgctatcaaaaccaaactttcttcatttgttactcttttcgtatacatttattttcttatactttcgcgctgttttgcaactgatctaaaactttttgtgtgattgtctttggcgggtgcag

SEQ ID NO: 1029 - DNA, 200 bp, Euphorbia heterophylla
ctgcacccgccaaagacaatcacacaaaaagttttagatcagttgcaaaacagcgcgaaagtataagaaaataaatgtatacgaaaagagtaacaaatgaagaaagtttggttttgatagcgcacctgaggaccagggaagccaccaactggccaaccaagaggccagttgacctccttctgaaggagtgtgtattcttg

SEQ ID NO: 1030 - DNA, 200 bp, Euphorbia heterophylla
gtgtgattgtctttggcgggtgcagggtccatactactgtggtgtaggggctgataaatcgtttggccgtgacattgtggatgctcactacaaggcttgcctgtatgccggtatcaatatcagtggaatcaacggtgaagtcatgccaggacaggtatgaaactatgaatgcatagtgtctattcagttggtttcgacag

SEQ ID NO: 1031 - DNA, 200 bp, Euphorbia heterophylla
ctgtcgaaaccaactgaatagacactatgcattcatagtttcatacctgtcctggcatgacttcaccgttgattccactgatattgataccggcatacaggcaagccttgtagtgagcatccacaatgtcacggccaaacgatttatcagcccctacaccacagtagtatggaccctgcacccgccaaagacaatcacac

SEQ ID NO: 1032 - DNA, 200 bp, Euphorbia heterophylla
gtgtctattcagttggtttcgacagctgatccataacacaacaatagtttcacactaatagtggattcgatgatctgatcaacattgcttgcttgatcttttttcgtgcagtgggaattccaagtcggacctactgttggaatttcttctggtgatcaagtctgggttgccagatacatcctagaggtaatctgttagtc

SEQ ID NO: 1033 - DNA, 200 bp, Euphorbia heterophylla
gactaacagattacctctaggatgtatctggcaacccagacttgatcaccagaagaaattccaacagtaggtccgacttggaattcccactgcacgaaaaaagatcaagcaagcaatgttgatcagatcatcgaatccactattagtgtgaaactattgttgtgttatggatcagctgtcgaaaccaactgaatagacac

SEQ ID NO: 1034 - DNA, 200 bp, Euphorbia heterophylla
acatcctagaggtaatctgttagtccttttctgctctacttattgttcgtgtttctcgcgtcttgcattctttggctatctcggtgtctgacccaatgctcgctctcatctacagaggattgcagagattgctggagtagttgttactttcgaccctaaaccagtgaaggtctgcctaatataccaatctttttttctgt

SEQ ID NO: 1035 - DNA, 200 bp, Euphorbia heterophylla
acagaaaaaaagattggtatattaggcagaccttcactggtttagggtcgaaagtaacaactactccagcaatctctgcaatcctctgtagatgagagcgagcattgggtcagacaccgagatagccaaagaatgcaagacgcgagaaacacgaacaataagtagagcagaaaaggactaacagattacctctaggatgt

SEQ ID NO: 1036 - DNA, 200 bp, Euphorbia heterophylla
ctaatataccaatctttttttctgtgaaaatttatgcaagagaatatcagttatcatgaaccaaatatacttttcttaatttttgtctgtttatttcaaaaaacatcagggtgactggaacggtgctggtgctcacactaactacaggtaattactccctccattccgttttatatgatcgcttgattaatcgtcaatga

SEQ ID NO: 1037 - DNA, 200 bp, Euphorbia heterophylla
tcattgacgattaatcaagcgatcatataaaacggaatggagggagtaattacctgtagttagtgtgagcaccagcaccgttccagtcaccctgatgttttttgaaataaacagacaaaaattaagaaaagtatatttggttcatgataactgatattctcttgcataaattttcacagaaaaaaagattggtatattag

SEQ ID NO: 1038 - DNA, 200 bp, Euphorbia heterophylla
tgatcgcttgattaatcgtcaatgaggaatacttgaattacctgatttactaatgcaatacttgaatttattatctacgagtcttcttcaatgccaattttatcagggttttgtttgcttaattgttcatgcagcactaagtcaatgaggaacgatggtggaatcgatgtgatcaagaaagcaatcgagaagttgagcct

SEQ ID NO: 1039 - DNA, 200 bp, Euphorbia heterophylla
aggctcaacttctcgattgctttcttgatcacatcgattccaccatcgttcctcattgacttagtgctgcatgaacaattaagcaaacaaaaccctgataaaattggcattgaagaagactcgtagataataaattcaagtattgcattagtaaatcaggtaattcaagtattcctcattgacgattaatcaagcgatca

SEQ ID NO: 1040 - DNA, 200 bp, Euphorbia heterophylla
agaaagcaatcgagaagttgagcctgcgccataaggaacacatttccgcctatggtgagggtaatgagaggaggctcactggtcgccatgagacagccgacatcaacactttctcctgggtaaacttcgttatacttcaactaactgttattaagcattagctagttttctaacaagagaccgattaatcttgtttaatc

SEQ ID NO: 1041 - DNA, 200 bp, Euphorbia heterophylla
gattaaacaagattaatcggtctcttgttagaaaactagctaatgcttaataacagttagttgaagtataacgaagtttacccaggagaaagtgttgatgtcggctgtctcatggcgaccagtgagcctcctctcattaccctcaccataggcggaaatgtgttccttatggcgcaggctcaacttctcgattgctttct

SEQ ID NO: 1042 - DNA, 200 bp, Euphorbia heterophylla
agagaccgattaatcttgtttaatcttactgttctatgtataatgtatgttcattagatttgtgtaagctgtttcttgtatcgtacgactaataatttgatacgtaactaattggaattcagggagtggcgaatagaggtgcttctgttcgtgttggtcgcgacacagagaaagatggcaaaggttaggaattctgttta

SEQ ID NO: 1043 - DNA, 200 bp, Euphorbia heterophylla
taaacagaattcctaacctttgccatctttctctgtgtcgcgaccaacacgaacagaagcacctctattcgccactccctgaattccaattagttacgtatcaaattattagtcgtacgatacaagaaacagcttacacaaatctaatgaacatacattatacatagaacagtaagattaaacaagattaatcggtctct

SEQ ID NO: 1044 - DNA, 200 bp, Euphorbia heterophylla
tggcaaaggttaggaattctgtttaatcttttcttttctgcttaacgtttgtttatgttcttctcaagtgcttttatttcgcccacattatttggcttaagcttaaatcacgaattttatactccgtaccacataggtacatatatatagatatagattatagcggaatgagagtaaacactgtaatatatagttcgagt

SEQ ID NO: 1045 - DNA, 200 bp, Euphorbia heterophylla
actcgaactatatattacagtgtttactctcattccgctataatctatatctatatatatgtacctatgtggtacggagtataaaattcgtgatttaagcttaagccaaataatgtgggcgaaataaaagcacttgagaagaacataaacaaacgttaagcagaaaagaaaagattaaacagaattcctaacctttgcca

SEQ ID NO: 1046 - DNA, 200 bp, Euphorbia heterophylla
aaacactgtaatatatagttcgagttttgaaccttttatttgaatctaacgcgtatattttttgttacgttaataggttacttcgaagaccgaaggccggcatcaaacatggatccctatgtcgtgacctccatgattgccgagacaactatcctatggaagccttgattggagaatctgaacgaatttgcattgtttag

SEQ ID NO: 1047 - DNA, 200 bp, Euphorbia heterophylla
ctaaacaatgcaaattcgttcagattctccaatcaaggcttccataggatagttgtctcggcaatcatggaggtcacgacatagggatccatgtttgatgccggccttcggtcttcgaagtaacctattaacgtaacaaaaaatatacgcgttagattcaaataaaaggttcaaaactcgaactatatattacagtgttt

SEQ ID NO: 1048 - DNA, 200 bp, Euphorbia heterophylla
atctgaacgaatttgcattgtttagacatttcaacgaacccacatcatgtttatgtgcatttgaataatcatacattgatgtcgtatttgggactagaattcctaaaatgcttgacatatcgtttggttgatcatttgtgagtagtgtaacgtgtactccttttcatctcatgcaagtgaattgttcttttaagttggat

SEQ ID NO: 1049 - DNA, 200 bp, Euphorbia heterophylla
atccaacttaaaagaacaattcacttgcatgagatgaaaaggagtacacgttacactactcacaaatgatcaaccaaacgatatgtcaagcattttaggaattctagtcccaaatacgacatcaatgtatgattattcaaatgcacataaacatgatgtgggttcgttgaaatgtctaaacaatgcaaattcgttcagat

SEQ ID NO: 1050 - DNA, 200 bp, Euphorbia heterophylla
agtgaattgttcttttaagttggattttgtttaccaaattgtgattggttgtttttatttattataattcttgcatttgattgaattagaatctattccgaaatttgcaactttcaatcgatttaacaaaaacatacactaatcgtaatctaaagacaaaattagggcaaaatcaaggggtttttctaaggtataccctt

SEQ ID NO: 1051 - DNA, 200 bp, Euphorbia heterophylla
aagggtataccttagaaaaaccccttgattttgccctaattttgtctttagattacgattagtgtatgtttttgttaaatcgattgaaagttgcaaatttcggaatagattctaattcaatcaaatgcaagaattataataaataaaaacaaccaatcacaatttggtaaacaaaatccaacttaaaagaacaattcact

SEQ ID NO: 1052 - DNA, 200 bp, Euphorbia heterophylla
aggggtttttctaaggtatacccttgaagttttgggttttccaaggtctacttatgccttttgaaactttcaagggatacccctgaactcaatacacattattattcatatcctcccctagttaaaacactcaccttagaataaaataaaaaataaaaacaaaataaattaaaaagccctaaatctcctccttcctccct

SEQ ID NO: 1053 - DNA, 200 bp, Euphorbia heterophylla
agggaggaaggaggagatttagggctttttaatttattttgtttttattttttattttattctaaggtgagtgttttaactaggggaggatatgaataataatgtgtattgagttcaggggtatcccttgaaagtttcaaaaggcataagtagaccttggaaaacccaaaacttcaagggtataccttagaaaaacccct

SEQ ID NO: 1054 - DNA, 200 bp, Euphorbia heterophylla
aagtcactgctattctgtgctaaactagatttatacttatttacaactgatgactgctgatttagtgatttagtgatttagatcgtactttctttgttttgctcgattttcggacgtcgattcgatatatacagatttgatgaacagcattgttgccaatgatcagtagtagtaatgttgttgaaagctttcagttatag

SEQ ID NO: 1055 - DNA, 200 bp, Euphorbia heterophylla
ctataactgaaagctttcaacaacattactactactgatcattggcaacaatgctgttcatcaaatctgtatatatcgaatcgacgtccgaaaatcgagcaaaacaaagaaagtacgatctaaatcactaaatcactaaatcagcagtcatcagttgtaaataagtataaatctagtttagcacagaatagcagtgactt

SEQ ID NO: 1056 - DNA, 200 bp, Euphorbia heterophylla
tgttgttgaaagctttcagttatagtgatatcttccatctgctagtttttttagagaaaatcagtttttgctaggaggaaaaagggaattactaaaaaaattataaatgttctttcaaaatttgagcgaagaaaataatggttattaaacactaattttgagctgaaagaatatgatcagatgcttttgtattctaatgt

SEQ ID NO: 1057 - DNA, 200 bp, Euphorbia heterophylla
acattagaatacaaaagcatctgatcatattctttcagctcaaaattagtgtttaataaccattattttcttcgctcaaattttgaaagaacatttataatttttttagtaattccctttttcctcctagcaaaaactgattttctctaaaaaaactagcagatggaagatatcactataactgaaagctttcaacaaca

SEQ ID NO: 1058 - DNA, 200 bp, Euphorbia heterophylla
atcagatgcttttgtattctaatgtcttgaatcctaatatgcacctttaaaaccttttgtttttcaatgaaaaagtaaggaaaaagattatttgcattagtggcacgagtctaatctaataaccgtggtttcgtctcttctctttcaaaaattggaaaagtgttgatgtcattttctaacatttcctactaagtactaac

SEQ ID NO: 1059 - DNA, 200 bp, Euphorbia heterophylla
gttagtacttagtaggaaatgttagaaaatgacatcaacacttttccaatttttgaaagagaagagacgaaaccacggttattagattagactcgtgccactaatgcaaataatctttttccttactttttcattgaaaaacaaaaggttttaaaggtgcatattaggattcaagacattagaatacaaaagcatctgat

SEQ ID NO: 1060 - DNA, 200 bp, Euphorbia heterophylla
ctaacatttcctactaagtactaaccaaaacaaggttttctttccactaatagaattttcctttaccacatttatacagtataaaaatctctaactttagactttagagcatactatcacatcatggtgttgtcatagtatattcatattagagcaggtttagccccaagtctgaagacttgggatgaaattacctttat

SEQ ID NO: 1061 - DNA, 200 bp, Euphorbia heterophylla
ataaaggtaatttcatcccaagtcttcagacttggggctaaacctgctctaatatgaatatactatgacaacaccatgatgtgatagtatgctctaaagtctaaagttagagatttttatactgtataaatgtggtaaaggaaaattctattagtggaaagaaaaccttgttttggttagtacttagtaggaaatgttag

SEQ ID NO: 1062 - DNA, 200 bp, Euphorbia heterophylla
agacttgggatgaaattacctttattgtcttaagatttagatttaagattttcccatttttcttttaaaatcttagccagatctcaagttgatttcaaggctcaacttaagacttgaaacacgggacccaccctaatttaataatgtttgttttcatatagataacataaagagataaaaaaaagtaaaatatcatggta

SEQ ID NO: 1063 - DNA, 200 bp, Euphorbia heterophylla
taccatgatattttacttttttttatctctttatgttatctatatgaaaacaaacattattaaattagggtgggtcccgtgtttcaagtcttaagttgagccttgaaatcaacttgagatctggctaagattttaaaagaaaaatgggaaaatcttaaatctaaatcttaagacaataaaggtaatttcatcccaagtct

SEQ ID NO: 1064 - DNA, 200 bp, Euphorbia heterophylla
taaaaaaaagtaaaatatcatggtatatatttaagactaggagtcttagggctaaagtgataaagttggacaagttttatggagtttaagaataattgataacattatttttgtgggaaccactaaaaaatgatgttacacccaagttttaagacttggtgctaagcttgctgttacaaattggtttcaatcataacagt

SEQ ID NO: 1065 - DNA, 200 bp, Euphorbia heterophylla
actgttatgattgaaaccaatttgtaacagcaagcttagcaccaagtcttaaaacttgggtgtaacatcattttttagtggttcccacaaaaataatgttatcaattattcttaaactccataaaacttgtccaactttatcactttagccctaagactcctagtcttaaatatataccatgatattttactttttttta

SEQ ID NO: 1066 - DNA, 200 bp, Euphorbia heterophylla
acaaattggtttcaatcataacagttattccttatctttgactaggaatttagtccaaatcttttgttgtggtgtactggtgtcgaggatacaacatggatacctaacgggaagaaaagagtttttgcaacttatattgtctgtctgtgtttaatgttgccacttctacgggaattctggtttctgtaatccaggattaa

SEQ ID NO: 1067 - DNA, 200 bp, Euphorbia heterophylla
ttaatcctggattacagaaaccagaattcccgtagaagtggcaacattaaacacagacagacaatataagttgcaaaaactcttttcttcccgttaggtatccatgttgtatcctcgacaccagtacaccacaacaaaagatttggactaaattcctagtcaaagataaggaataactgttatgattgaaaccaatttgt

SEQ ID NO: 1068 - DNA, 200 bp, Euphorbia heterophylla
tctggtttctgtaatccaggattaaagagctgtcagctgttgtactgtaaattgtttgtgtaatagttttaatttttgtagggaaaggaccaaatatggcccagattctcgctcctagcatgcaatgtcagttgaaattctcaaaaagctcattaagctcgctagcatcgaacacgtggacctccattttgctaaaagga

SEQ ID NO: 1069 - DNA, 200 bp, Euphorbia heterophylla
tccttttagcaaaatggaggtccacgtgttcgatgctagcgagcttaatgagctttttgagaatttcaactgacattgcatgctaggagcgagaatctgggccatatttggtcctttccctacaaaaattaaaactattacacaaacaatttacagtacaacagctgacagctctttaatcctggattacagaaaccaga

SEQ ID NO: 1070 - DNA, 200 bp, Euphorbia heterophylla
gtggacctccattttgctaaaaggaaaccaaaagagatcgcttcattgctcaactaagttcaaggtatccgctgctctcaaatctgatgatggtactatcaacagggtagagcagctactcaatttggatgtcactccatacactgacaagattattgctgaatacatatggtatagtttcccattctgattttggcatc

SEQ ID NO: 1071 - DNA, 200 bp, Euphorbia heterophylla
gatgccaaaatcagaatgggaaactataccatatgtattcagcaataatcttgtcagtgtatggagtgacatccaaattgagtagctgctctaccctgttgatagtaccatcatcagatttgagagcagcggataccttgaacttagttgagcaatgaagcgatctcttttggtttccttttagcaaaatggaggtccac

SEQ ID NO: 1072 - DNA, 200 bp, Euphorbia heterophylla
agtttcccattctgattttggcatctttatcgagggttattttttctcaaatatgcttgatgaggttatggtagaatcaacatattagggctttacttgcatggttgtattaggctcttttgttgtagaaaagcctgcttggtaattcagtgtccaggtgttgatggaactaattgaattatgattgttcattggaatag

SEQ ID NO: 1073 - DNA, 200 bp, Euphorbia heterophylla
ctattccaatgaacaatcataattcaattagttccatcaacacctggacactgaattaccaagcaggcttttctacaacaaaagagcctaatacaaccatgcaagtaaagccctaatatgttgattctaccataacctcatcaagcatatttgagaaaaaataaccctcgataaagatgccaaaatcagaatgggaaact

SEQ ID NO: 1074 - DNA, 200 bp, Euphorbia heterophylla
gaattatgattgttcattggaataggattggaggatctgggattgatgttcgcagtaaatccagggtatagtaacatccattctgtagcttgattgttaaccacctattagatgctgactaatgttttcttaataataccagacaatctcaagacctattgaggatccatctgaacttcccaaatggaactttgatgggt

SEQ ID NO: 1075 - DNA, 200 bp, Euphorbia heterophylla
acccatcaaagttccatttgggaagttcagatggatcctcaataggtcttgagattgtctggtattattaagaaaacattagtcagcatctaataggtggttaacaatcaagctacagaatggatgttactataccctggatttactgcgaacatcaatcccagatcctccaatcctattccaatgaacaatcataattc

SEQ ID NO: 1076 - DNA, 200 bp, Euphorbia heterophylla
cttcccaaatggaactttgatgggtcaagcactggacaagcgccgggagaagacagtgaagtaatcttatagtaagatcctcttacatctatgaatcttcatcattttccccataaattcattattcattatttccgagtctttcttttattcttgtcttttaatgactgatcattagtcattgttgtcttgcatttctt

SEQ ID NO: 1077 - DNA, 200 bp, Euphorbia heterophylla
aagaaatgcaagacaacaatgactaatgatcagtcattaaaagacaagaataaaagaaagactcggaaataatgaataatgaatttatggggaaaatgatgaagattcatagatgtaagaggatcttactataagattacttcactgtcttctcccggcgcttgtccagtgcttgacccatcaaagttccatttgggaag

SEQ ID NO: 1078 - DNA, 200 bp, Euphorbia heterophylla
tagtcattgttgtcttgcatttcttctgcaatagccctcaagcaatttttaaggatccttttcgtggtggtaacaatatcttggtgagtttgatagagcatatgaatcggttattctaaagttatagtatttcttataaataataaatttatttgttaaggttgcaaccataatttatgatttgtaaatctaggtgatct

SEQ ID NO: 1079 - DNA, 200 bp, Euphorbia heterophylla
agatcacctagatttacaaatcataaattatggttgcaaccttaacaaataaatttattatttataagaaatactataactttagaataaccgattcatatgctctatcaaactcaccaagatattgttaccaccacgaaaaggatccttaaaaattgcttgagggctattgcagaagaaatgcaagacaacaatgacta

SEQ ID NO: 1080 - DNA, 200 bp, Euphorbia heterophylla
tatgatttgtaaatctaggtgatctgtgatgcatacacaccagcaggtgaacccatcccaactaataaacgacacaaagctgcacagatcttcagcaaccaaaaggttgtttctgaggttccatggtatgaagttccttgtactgataaaatccatttatgaattgttaataaccactttgcatttgaacattaaatttt

SEQ ID NO: 1081 - DNA, 200 bp, Euphorbia heterophylla
aaaatttaatgttcaaatgcaaagtggttattaacaattcataaatggattttatcagtacaaggaacttcataccatggaacctcagaaacaaccttttggttgctgaagatctgtgcagctttgtgtcgtttattagttgggatgggttcacctgctggtgtgtatgcatcacagatcacctagatttacaaatcata

SEQ ID NO: 1082 - DNA, 200 bp, Euphorbia heterophylla
actttgcatttgaacattaaattttgtgtacaaagtttcctattataggaaggataattaattaatcataattgggagggtgaaattgagaagaaaaaagaggattgcatgaacagtccaatgcattttgttgctgacatgagagcaatttggggctttgtagagctggctggattgtggaatgtaatcaacaggaaact

SEQ ID NO: 1083 - DNA, 200 bp, Euphorbia heterophylla
agtttcctgttgattacattccacaatccagccagctctacaaagccccaaattgctctcatgtcagcaacaaaatgcattggactgttcatgcaatcctcttttttcttctcaatttcaccctcccaattatgattaattaattatccttcctataataggaaactttgtacacaaaatttaatgttcaaatgcaaagt

SEQ ID NO: 1084 - DNA, 200 bp, Euphorbia heterophylla
tgtggaatgtaatcaacaggaaactgatgactgaccactgtgaatatgatctgttatgacacatttcatttttcgaatagaggaatttcattgccaggttgacctataacagtataactatgtcagaacagagcttctcgatttcaaaattgtgttggcttttttctttttcaaataatcagaagagactcatctttagt

SEQ ID NO: 1085 - DNA, 200 bp, Euphorbia heterophylla
actaaagatgagtctcttctgattatttgaaaaagaaaaaagccaacacaattttgaaatcgagaagctctgttctgacatagttatactgttataggtcaacctggcaatgaaattcctctattcgaaaaatgaaatgtgtcataacagatcatattcacagtggtcagtcatcagtttcctgttgattacattccaca

SEQ ID NO: 1086 - DNA, 200 bp, Euphorbia heterophylla
taatcagaagagactcatctttagttttctgtgttatcgttctactttaagcttttattactctttgttttagtcatttaatcatatttttacaggtttggaatagagcaggaatacacgcttcttcaaccaaatgttaattggcccttgggatggcctgtgggagcttatcccggtcctcaagtatgttactcagttgc

SEQ ID NO: 1087 - DNA, 200 bp, Euphorbia heterophylla
gcaactgagtaacatacttgaggaccgggataagctcccacaggccatcccaagggccaattaacatttggttgaagaagcgtgtattcctgctctattccaaacctgtaaaaatatgattaaatgactaaaacaaagagtaataaaagcttaaagtagaacgataacacagaaaactaaagatgagtctcttctgatta

SEQ ID NO: 1088 - DNA, 200 bp, Euphorbia heterophylla
gtcctcaagtatgttactcagttgctcctatttcatattcattttgtccaatgaagatgctttgttgtgttatagattagaatcgttttgttacgcaaaatgatttttttcgcattttctagggtccatattattgtggtgttggtgctgaaaaatcttttggacgtgacatttctgatgctcactataaagcttgcctg

SEQ ID NO: 1089 - DNA, 200 bp, Euphorbia heterophylla
caggcaagctttatagtgagcatcagaaatgtcacgtccaaaagatttttcagcaccaacaccacaataatatggaccctagaaaatgcgaaaaaaatcattttgcgtaacaaaacgattctaatctataacacaacaaagcatcttcattggacaaaatgaatatgaaataggagcaactgagtaacatacttgaggac

SEQ ID NO: 1090 - DNA, 200 bp, Euphorbia heterophylla
tgatgctcactataaagcttgcctgtatgctggaattaacatcagtggcaccaatggggaagttatgcctggccaggtattcacttacatcattctagtatgtctaccagtcataaatttgctttgaatcttgtaactcaatagctgtatatccacttgtacctacagtgggaattccaggttggtcctagtgttgggat

SEQ ID NO: 1091 - DNA, 200 bp, Euphorbia heterophylla
atcccaacactaggaccaacctggaattcccactgtaggtacaagtggatatacagctattgagttacaagattcaaagcaaatttatgactggtagacatactagaatgatgtaagtgaatacctggccaggcataacttccccattggtgccactgatgttaattccagcatacaggcaagctttatagtgagcatca

SEQ ID NO: 1092 - DNA, 200 bp, Euphorbia heterophylla
tccaggttggtcctagtgttgggattgaagcaggagatcatatctggtgtgccagatatattcttgaggtattctcctgcaatttgtatgtttccctctgcgcttatcagttacaactatagttttgtaatttgctgccctatcgttttattattcattatttttctacttgaattctgcttgaaagaaaataagctact

SEQ ID NO: 1093 - DNA, 200 bp, Euphorbia heterophylla
agtagcttattttctttcaagcagaattcaagtagaaaaataatgaataataaaacgatagggcagcaaattacaaaactatagttgtaactgataagcgcagagggaaacatacaaattgcaggagaatacctcaagaatatatctggcacaccagatatgatctcctgcttcaatcccaacactaggaccaacctgga

SEQ ID NO: 1094 - DNA, 200 bp, Euphorbia heterophylla
tctgcttgaaagaaaataagctactttgacacagactcgaagtgaaagtgaccatatgagaatcaaactgaccttggaattatatgtgattaacaaccgaatctaatctcttatggaagacataaattaataatacttaataggctccaatgtggatgacctcccggaataatcacttttggttcatgttagccgacccc

SEQ ID NO: 1095 - DNA, 200 bp, Euphorbia heterophylla
ggggtcggctaacatgaaccaaaagtgattattccgggaggtcatccacattggagcctattaagtattattaatttatgtcttccataagagattagattcggttgttaatcacatataattccaaggtcagtttgattctcatatggtcactttcacttcgagtctgtgtcaaagtagcttattttctttcaagcaga

SEQ ID NO: 1096 - DNA, 200 bp, Euphorbia heterophylla
cttttggttcatgttagccgacccctcatatgtgattaaggctttgattgattgattgaataggctccaatgtgacccaaactcaccaagggtaaataaatgctattttacctgtattgtatggctaactatggctaaccagatataaccataactgaattgttaaactgaataatttaagaatcataagtagctttata

SEQ ID NO: 1097 - DNA, 200 bp, Euphorbia heterophylla
tataaagctacttatgattcttaaattattcagtttaacaattcagttatggttatatctggttagccatagttagccatacaatacaggtaaaatagcatttatttacccttggtgagtttgggtcacattggagcctattcaatcaatcaatcaaagccttaatcacatatgaggggtcggctaacatgaaccaaaag

SEQ ID NO: 1098 - DNA, 200 bp, Euphorbia heterophylla
tttaagaatcataagtagctttataatgtagggacattggggtgactcatgacgagggagtgaggcacaaatgaaataggtctaaaatgaactattgatgaatatttaagtttgcaattgaagatccacattatcatctaattgtaaaacataattgctaatgctcaacagaacctagtcctttaagtagaagccaaatt

SEQ ID NO: 1099 - DNA, 200 bp, Euphorbia heterophylla
aatttggcttctacttaaaggactaggttctgttgagcattagcaattatgttttacaattagatgataatgtggatcttcaattgcaaacttaaatattcatcaatagttcattttagacctatttcatttgtgcctcactccctcgtcatgagtcaccccaatgtccctacattataaagctacttatgattcttaaa

SEQ ID NO: 1100 - DNA, 200 bp, Euphorbia heterophylla
tagtcctttaagtagaagccaaattcattagaagtttagcacattgtgaaaccttgatccatatcaatatatgtaggctgaagaaattacagctcaaattttgttattagttgtagctttagtgttgagttaagtataaactataaagatgggcactcaactttagacaaaatcgcaatttgagcactcaactttagaca

SEQ ID NO: 1101 - DNA, 200 bp, Euphorbia heterophylla
tgtctaaagttgagtgctcaaattgcgattttgtctaaagttgagtgcccatctttatagtttatacttaactcaacactaaagctacaactaataacaaaatttgagctgtaatttcttcagcctacatatattgatatggatcaaggtttcacaatgtgctaaacttctaatgaatttggcttctacttaaaggacta

SEQ ID NO: 1102 - DNA, 200 bp, Euphorbia heterophylla
caatttgagcactcaactttagacaaaattgcaatttgagcactcaactttgaaaagttgcaagttgattactaattttggttaactatagttctaccctcctccatccttaaatctcttgctactagtccagcaccacaatcaaaatcctagcagtcatgctaccaatttgccactgaccattcaatccactagagaac

SEQ ID NO: 1103 - DNA, 200 bp, Euphorbia heterophylla
gttctctagtggattgaatggtcagtggcaaattggtagcatgactgctaggattttgattgtggtgctggactagtagcaagagatttaaggatggaggagggtagaactatagttaaccaaaattagtaatcaacttgcaacttttcaaagttgagtgctcaaattgcaattttgtctaaagttgagtgctcaaattg

SEQ ID NO: 1104 - DNA, 200 bp, Euphorbia heterophylla
ctgaccattcaatccactagagaaccccccaaaaagcaccatgcaccagtgcaccaccacccaaaaaaatcacgggtcaccacgatggaaccaactattaagaaaaaacccaccattaccaccattaaatttgaaccaactattaaagaattgcttaatttgtacacaatgatcataaaaaaaaagtttgcaccccattc

SEQ ID NO: 1105 - DNA, 200 bp, Euphorbia heterophylla
gaatggggtgcaaactttttttttatgatcattgtgtacaaattaagcaattctttaatagttggttcaaatttaatggtggtaatggtgggttttttcttaatagttggttccatcgtggtgacccgtgatttttttgggtggtggtgcactggtgcatggtgctttttggggggttctctagtggattgaatggtcag

SEQ ID NO: 1106 - DNA, 200 bp, Euphorbia heterophylla
taaaaaaaaagtttgcaccccattcaatagaagtgaagaatgttatacggagtacaatgaatcaaacataaaattcagccaattgacaattacaatttcttcaaagctgccataaatgaaaaaccatactcactatcaaatttgaaagaaaaccatcaaattcaaacccataattagaagtaaaagtgttgggtaaagcg

SEQ ID NO: 1107 - DNA, 200 bp, Euphorbia heterophylla
cgctttacccaacacttttacttctaattatgggtttgaatttgatggttttctttcaaatttgatagtgagtatggtttttcatttatggcagctttgaagaaattgtaattgtcaattggctgaattttatgtttgattcattgtactccgtataacattcttcacttctattgaatggggtgcaaacttttttttta

SEQ ID NO: 1108 - DNA, 200 bp, Euphorbia heterophylla
aatatgcgtgaaaagtacaattattaataatttgtccaataaatattttgttgttaaagattttaagaggttgaaaaagtagtatattttttggttgaaaaagaatggagaataaacaatatcaaaacaataaataaagcagtatctaaaagtagagtgtaatttgtgtagtccactctttaaaagagtaccaaaagttg

SEQ ID NO: 1109 - DNA, 200 bp, Euphorbia heterophylla
caacttttggtactcttttaaagagtggactacacaaattacactctacttttagatactgctttatttattgttttgatattgtttattctccattctttttcaaccaaaaaatatactactttttcaacctcttaaaatctttaacaacaaaatatttattggacaaattattaataattgtacttttcacgcatatt

SEQ ID NO: 1110 - DNA, 200 bp, Euphorbia heterophylla
ctctttaaaagagtaccaaaagttgaggacttcctcatcataccattttatattggttgtttcagacatcactctatatattaggcgtcattttgcgattcatttcacgcatttcttgatcacattctcacaatatctttcgttctctcaatattttccataaacaatattcacaacaacaacatgtcgcttctctcaga

SEQ ID NO: 1111 - DNA, 200 bp, Euphorbia heterophylla
tctgagagaagcgacatgttgttgttgtgaatattgtttatggaaaatattgagagaacgaaagatattgtgagaatgtgatcaagaaatgcgtgaaatgaatcgcaaaatgacgcctaatatatagagtgatgtctgaaacaaccaatataaaatggtatgatgaggaagtcctcaacttttggtactcttttaaagag

SEQ ID NO: 1112 - DNA, 200 bp, Euphorbia heterophylla
acaacaacatgtcgcttctctcagatctcattaaccttgatctttctgattctactgataagatcattgctgagtacatatggtcagttctttattattgcacaccatcttttcgattttattacccaatgaataaagttttattttttctgggtttttctcttttagcagaaagatttcattaacaacttaattcacaa

SEQ ID NO: 1113 - DNA, 200 bp, Euphorbia heterophylla
ttgtgaattaagttgttaatgaaatctttctgctaaaagagaaaaacccagaaaaaataaaactttattcattgggtaataaaatcgaaaagatggtgtgcaataataaagaactgaccatatgtactcagcaatgatcttatcagtagaatcagaaagatcaaggttaatgagatctgagagaagcgacatgttgttgt

SEQ ID NO: 1114 - DNA, 200 bp, Euphorbia heterophylla
atttcattaacaacttaattcacaatgaaggatttcagcttttttagttatgaatagtttgatgaagaaaagtgatgggttgtatcttatatattttatctgtttgttcttaatatgggatattttccagtgttacaatattgcttatttgactagcaaaagatatttatcttatttttcattgaacaaaatatgcacat

SEQ ID NO: 1115 - DNA, 200 bp, Euphorbia heterophylla
atgtgcatattttgttcaatgaaaaataagataaatatcttttgctagtcaaataagcaatattgtaacactggaaaatatcccatattaagaacaaacagataaaatatataagatacaacccatcacttttcttcatcaaactattcataactaaaaaagctgaaatccttcattgtgaattaagttgttaatgaaat

SEQ ID NO: 1116 - DNA, 200 bp, Euphorbia heterophylla
ttttcattgaacaaaatatgcacataatgattttcttttattggaagtcatagtgtagtaatcaagaacttgctgtgaatttattttcaggattggtggatctggtatggacatgagaagtaaagctagagtgtagtttttttttctttttttgtttattgtattatttttaaccttaaaccttcacctaccaaaatgaa

SEQ ID NO: 1117 - DNA, 200 bp, Euphorbia heterophylla
ttcattttggtaggtgaaggtttaaggttaaaaataatacaataaacaaaaaaagaaaaaaaaactacactctagctttacttctcatgtccataccagatccaccaatcctgaaaataaattcacagcaagttcttgattactacactatgacttccaataaaagaaaatcattatgtgcatattttgttcaatgaaaa

SEQ ID NO: 1118 - DNA, 200 bp, Euphorbia heterophylla
caaaagcactttatcttttcattgtattttccttttgggttggaaagagcattttaaagttaagctgaataaaggctacaaagttgcacattcaaactatcctaggaaatggcaaagatatgctttacgtataaactctgcataaattgttgttcacatgtagaagagggctttcgtttttgtagtttgctatagaatga

SEQ ID NO: 1119 - DNA, 200 bp, Euphorbia heterophylla
tcattctatagcaaactacaaaaacgaaagccctcttctacatgtgaacaacaatttatgcagagtttatacgtaaagcatatctttgccatttcctaggatagtttgaatgtgcaactttgtagcctttattcagcttaactttaaaatgctctttccaacccaaaaggaaaatacaatgaaaagataaagtgcttttg

SEQ ID NO: 1120 - DNA, 200 bp, Euphorbia heterophylla
gtttttgtagtttgctatagaatgaatgggaagaggtctttgggacttctttttgtttccaatttcttcctattctaggtgttttgttgatataatgttcgttttccattaatttgttattgtgcagttgataaataaataaaattgtgcttcttatttataagaatgtatcccactgacctttctttctactacctcta

SEQ ID NO: 1121 - DNA, 200 bp, Euphorbia heterophylla
tagaggtagtagaaagaaaggtcagtgggatacattcttataaataagaagcacaattttatttatttatcaactgcacaataacaaattaatggaaaacgaacattatatcaacaaaacacctagaataggaagaaattggaaacaaaaagaagtcccaaagacctcttcccattcattctatagcaaactacaaaaac

SEQ ID NO: 1122 - DNA, 200 bp, Euphorbia heterophylla
ctgacctttctttctactacctctaaacatactgggcttatatgttttcctcgtcaggggtaatggcgaagagatggttttgtcagacatgcatgttaaacctggtgaaccttgggaatattgcccgagggaggcattaaggagggctgcaaaagtgctgaaagaagaattcaatttggtatctttgtaatgcctaaaat

SEQ ID NO: 1123 - DNA, 200 bp, Euphorbia heterophylla
attttaggcattacaaagataccaaattgaattcttctttcagcacttttgcagccctccttaatgcctccctcgggcaatattcccaaggttcaccaggtttaacatgcatgtctgacaaaaccatctcttcgccattacccctgacgaggaaaacatataagcccagtatgtttagaggtagtagaaagaaaggtcag

SEQ ID NO: 1124 - DNA, 200 bp, Euphorbia heterophylla
ttggtatctttgtaatgcctaaaatgtttcaataacttagttctatctatttttatatctgactgtttcgtgttgcatgtttaggaattggattcaggctttgagaatgaattttatctcttgaaacctatcacaaggtgattagattgaaccctgttttttcttttcattttcctttgattagtatctgattgctggtt

SEQ ID NO: 1125 - DNA, 200 bp, Euphorbia heterophylla
aaccagcaatcagatactaatcaaaggaaaatgaaaagaaaaaacagggttcaatctaatcaccttgtgataggtttcaagagataaaattcattctcaaagcctgaatccaattcctaaacatgcaacacgaaacagtcagatataaaaatagatagaactaagttattgaaacattttaggcattacaaagataccaa

SEQ ID NO: 1126 - DNA, 200 bp, Euphorbia heterophylla
tttgattagtatctgattgctggttaattatagggatggaagagaagaatgggttccatttgattcgagcccatattgttcaacttcatcttttgatgcagcttctcccatccttcaggaaatgttcggtgcactgcagtctctagatattacaatggaacaggtagggagtgaataatatttattgttggcctctgtat

SEQ ID NO: 1127 - DNA, 200 bp, Euphorbia heterophylla
atacagaggccaacaataaatattattcactccctacctgttccattgtaatatctagagactgcagtgcaccgaacatttcctgaaggatgggagaagctgcatcaaaagatgaagttgaacaatatgggctcgaatcaaatggaacccattcttctcttccatccctataattaaccagcaatcagatactaatcaaa

SEQ ID NO: 1128 - DNA, 200 bp, Euphorbia heterophylla
taatatttattgttggcctctgtatgttactttgagaagacaaaaatattctactgtcacctgacctctatatgtatctttataagcttaattgtctagagaattttatcttgataaccatcggtggacctatgttgtaccacagtgatgcacgtgctacacgtaaaaaattaaaaatatattggtgaaatggtcaacta

SEQ ID NO: 1129 - DNA, 200 bp, Euphorbia heterophylla
tagttgaccatttcaccaatatatttttaattttttacgtgtagcacgtgcatcactgtggtacaacataggtccaccgatggttatcaagataaaattctctagacaattaagcttataaagatacatatagaggtcaggtgacagtagaatatttttgtcttctcaaagtaacatacagaggccaacaataaatatta

SEQ ID NO: 1130 - DNA, 200 bp, Euphorbia heterophylla
aatatattggtgaaatggtcaactaaaattatataaaatattagaaccctaattaatttataccatatcttataaaataaaaataaaaaatatattcaaatgttactttatacatattttcatttaaattcatgtattcacacaacctcagataatttaatttgtattttgtaatttaatgctacaattaatatatatat

SEQ ID NO: 1131 - DNA, 200 bp, Euphorbia heterophylla
atatatatattaattgtagcattaaattacaaaatacaaattaaattatctgaggttgtgtgaatacatgaatttaaatgaaaatatgtataaagtaacatttgaatatattttttatttttattttataagatatggtataaattaattagggttctaatattttatataattttagttgaccatttcaccaatatatt

SEQ ID NO: 1132 - DNA, 200 bp, Euphorbia heterophylla
ttaatgctacaattaatatatatattccctccgttccatattgttctgtgcacttttcccatttggacgttccataatgatttgtgcattgtgctttatttcatttttagacatgcctttattattttttaatagggtggacctaccactttctccatttacacattctctctccaatctatttttgctttttgacccaa

SEQ ID NO: 1133 - DNA, 200 bp, Euphorbia heterophylla
ttgggtcaaaaagcaaaaatagattggagagagaatgtgtaaatggagaaagtggtaggtccaccctattaaaaaataataaaggcatgtctaaaaatgaaataaagcacaatgcacaaatcattatggaacgtccaaatgggaaaagtgcacagaacaatatggaacggagggaatatatatattaattgtagcattaa

SEQ ID NO: 1134 - DNA, 200 bp, Euphorbia heterophylla
aatctatttttgctttttgacccaacttctattataatatgttattcttactttttccccaaatagtaaatgcacaaaacaatatggaacggagggagtacaataatatgtaagttattttagttgatactacacttgatataatatataatatctatttttggtgattcgatgtgggtgaggttaaacactaaattatt

SEQ ID NO: 1135 - DNA, 200 bp, Euphorbia heterophylla
aataatttagtgtttaacctcacccacatcgaatcaccaaaaatagatattatatattatatcaagtgtagtatcaactaaaataacttacatattattgtactccctccgttccatattgttttgtgcatttactatttggggaaaaagtaagaataacatattataatagaagttgggtcaaaaagcaaaaatagatt

SEQ ID NO: 1136 - DNA, 200 bp, Euphorbia heterophylla
gggtgaggttaaacactaaattatttgtacatattatgtacaaatacaacttaacacaataatttgtatttaagaataatttaccaagaggtttctgatgattagtattgctttcctattcattcttaagcgttccttgaaatcacttgtagccgaaagctgtctttacaatcctatttcatcatagagtttctgatttt

SEQ ID NO: 1137 - DNA, 200 bp, Euphorbia heterophylla
aaaatcagaaactctatgatgaaataggattgtaaagacagctttcggctacaagtgatttcaaggaacgcttaagaatgaataggaaagcaatactaatcatcagaaacctcttggtaaattattcttaaatacaaattattgtgttaagttgtatttgtacataatatgtacaaataatttagtgtttaacctcaccc

SEQ ID NO: 1138 - DNA, 200 bp, Euphorbia heterophylla
atttcatcatagagtttctgattttctaactactgctgaatgcgaagaattttgtaactacattgctgaatgcgaagaattttgtaactacattgctgaatgcgatgaattttgtaaactacattcttagcaatgcatgttaaatgattatttgacatggacaaaataagtgtaacaatagcaagttgatcgccgattgt

SEQ ID NO: 1139 - DNA, 200 bp, Euphorbia heterophylla
acaatcggcgatcaacttgctattgttacacttattttgtccatgtcaaataatcatttaacatgcattgctaagaatgtagtttacaaaattcatcgcattcagcaatgtagttacaaaattcttcgcattcagcaatgtagttacaaaattcttcgcattcagcagtagttagaaaatcagaaactctatgatgaaat

SEQ ID NO: 1140 - DNA, 200 bp, Euphorbia heterophylla
caatagcaagttgatcgccgattgtgacataattaattaatcaaattcaaaagctctcaattttttttattgcaggatattatttgaaaagctatttaaattcttgttttggctcacttatatacaaccaaatgctctttctctcgatgtgaattagaaatcttattttcttcattggtttggcgccacacctattgtca

SEQ ID NO: 1141 - DNA, 200 bp, Euphorbia heterophylla
tgacaataggtgtggcgccaaaccaatgaagaaaataagatttctaattcacatcgagagaaagagcatttggttgtatataagtgagccaaaacaagaatttaaatagcttttcaaataatatcctgcaataaaaaaaattgagagcttttgaatttgattaattaattatgtcacaatcggcgatcaacttgctattg

SEQ ID NO: 1142 - DNA, 200 bp, Euphorbia heterophylla
ctctctctatcccaaatttctgcaatacccacttccttttttcacccaaagctaggagtgggcgaaaatggcgcaaatcttggcaccatgtgcacagttacagatgagagtcccaaagaactcgacacctgcaagccccttatcaacaaagatgtggagctctctattcttaaagcagaacaagaaatcaacggctagga

SEQ ID NO: 1143 - DNA, 200 bp, Euphorbia heterophylla
tcctagccgttgatttcttgttctgctttaagaatagagagctccacatctttgttgataaggggcttgcaggtgtcgagttctttgggactctcatctgtaactgtgcacatggtgccaagatttgcgccattttcgcccactcctagctttgggtgaaaaaaggaagtgggtattgcagaaatttgggatagagagag

SEQ ID NO: 1144 - DNA, 200 bp, Euphorbia heterophylla
cagaacaagaaatcaacggctaggaacacttccaagcttagagtttatgccgtcaagtccgaaagtggcacaatcaataggctagaggaccttctaaatttggacattaccccttacaccgacaagatcattgccgagtatatttggattggaggaaccggtgtagatgtccgaagcaaatcaaggactatctcgaagcc

SEQ ID NO: 1145 - DNA, 200 bp, Euphorbia heterophylla
ggcttcgagatagtccttgatttgcttcggacatctacaccggttcctccaatccaaatatactcggcaatgatcttgtcggtgtaaggggtaatgtccaaatttagaaggtcctctagcctattgattgtgccactttcggacttgacggcataaactctaagcttggaagtgttcctagccgttgatttcttgttctg

SEQ ID NO: 1146 - DNA, 200 bp, Euphorbia heterophylla
gcaaatcaaggactatctcgaagccagttgaacatccatccgagcttccgaagtggaactacgatggatcgagtaccggacaagcgccaggcgaggatagtgaagttattctatatcctcaggctatctttaaggacccattccgagggggtaacaatatcttggtcatttgtgatgcatatactccagctggcgagcca

SEQ ID NO: 1147 - DNA, 200 bp, Euphorbia heterophylla
tggctcgccagctggagtatatgcatcacaaatgaccaagatattgttaccccctcggaatgggtccttaaagatagcctgaggatatagaataacttcactatcctcgcctggcgcttgtccggtactcgatccatcgtagttccacttcggaagctcggatggatgttcaactggcttcgagatagtccttgatttgc

SEQ ID NO: 1148 - DNA, 200 bp, Euphorbia heterophylla
tgcatatactccagctggcgagccaatcccaaccaataagcgccatcgagctgccgaaattttcagtaaccagaaggttattgatgaagtaccatggtatgggatcgagcaagagtacaccttgcttcaaacaaatgtgaattggcctttgggttggccagttggaggctatcctggtcctcagggtccttactattgtg

SEQ ID NO: 1149 - DNA, 200 bp, Euphorbia heterophylla
cacaatagtaaggaccctgaggaccaggatagcctccaactggccaacccaaaggccaattcacatttgtttgaagcaaggtgtactcttgctcgatcccataccatggtacttcatcaataaccttctggttactgaaaatttcggcagctcgatggcgcttattggttgggattggctcgccagctggagtatatgca

SEQ ID NO: 1150 - DNA, 200 bp, Euphorbia heterophylla
ggtcctcagggtccttactattgtgcagctggggcggataagtcatttggccgtgacatatcggacgctcattataaggcttgtttatatgccggaattaacattagtggcaccaatggggaggttatgcctggccagtgggagtatcaagtcggtccaagtgtgggaattgaggctggcgatcacatttggtgttcaag

SEQ ID NO: 1151 - DNA, 200 bp, Euphorbia heterophylla
cttgaacaccaaatgtgatcgccagcctcaattcccacacttggaccgacttgatactcccactggccaggcataacctccccattggtgccactaatgttaattccggcatataaacaagccttataatgagcgtccgatatgtcacggccaaatgacttatccgccccagctgcacaatagtaaggaccctgaggacc

SEQ ID NO: 1152 - DNA, 200 bp, Euphorbia heterophylla
ctggcgatcacatttggtgttcaagatacattcttgagagaatcaccgaacaagctggagttgttctcacattggaccccaagccgatcgagggtgattggaatggtgctgggtgtcacactaattacagtacaaaaagtatgagagaagaaggtggatttgaagtgataaagaaagcgattttgaacctctcacttcgc

SEQ ID NO: 1153 - DNA, 200 bp, Euphorbia heterophylla
gcgaagtgagaggttcaaaatcgctttctttatcacttcaaatccaccttcttctctcatactttttgtactgtaattagtgtgacacccagcaccattccaatcaccctcgatcggcttggggtccaatgtgagaacaactccagcttgttcggtgattctctcaagaatgtatcttgaacaccaaatgtgatcgccag

SEQ ID NO: 1154 - DNA, 200 bp, Euphorbia heterophylla
agcgattttgaacctctcacttcgccataaggatcacattagtgcctatggtgaaggaaatgagagaaggttgaccggaaaacacgaaaccgccagcattgactcgttttcttggggagtggcaaatcgtggatgctcgattcgagtaggtcgtgatactgagaagaatggcaaaggttacttggaagacagaagacccg

SEQ ID NO: 1155 - DNA, 200 bp, Euphorbia heterophylla
cgggtcttctgtcttccaagtaacctttgccattcttctcagtatcacgacctactcgaatcgagcatccacgatttgccactccccaagaaaacgagtcaatgctggcggtttcgtgttttccggtcaaccttctctcatttccttcaccataggcactaatgtgatccttatggcgaagtgagaggttcaaaatcgct

SEQ ID NO: 1156 - DNA, 200 bp, Euphorbia heterophylla
ggttacttggaagacagaagacccgcgtcgaacatggacccttatgtggtgacctcgttactagccgagactacgcttttatgggagccaactttggaggctgaagctcttgcagctcaaaaattatccttgaaagtataatcgactcggttcgagaaattctcgagctttcgggaattagtaatttcgttaaagttcgc

SEQ ID NO: 1157 - DNA, 200 bp, Euphorbia heterophylla
gcgaactttaacgaaattactaattcccgaaagctcgagaatttctcgaaccgagtcgattatactttcaaggataatttttgagctgcaagagcttcagcctccaaagttggctcccataaaagcgtagtctcggctagtaacgaggtcaccacataagggtccatgttcgacgcgggtcttctgtcttccaagtaacc

SEQ ID NO: 1158 - DNA, 200 bp, Euphorbia heterophylla
tttatgccgttaagtcagaaagtggcacaatcaataggctagaggaccttctaaatttggacattaccccttacaccgacaagatcatcgccgaatatatttggtacattttttttcgccctttttaatcttttaccgaaatgttcgtcatattttgtattatcacatattgataatcacattttgaattaggattggag

SEQ ID NO: 1159 - DNA, 200 bp, Euphorbia heterophylla
ctccaatcctaattcaaaatgtgattatcaatatgtgataatacaaaatatgacgaacatttcggtaaaagattaaaaagggcgaaaaaaaatgtaccaaatatattcggcgatgatcttgtcggtgtaaggggtaatgtccaaatttagaaggtcctctagcctattgattgtgccactttctgacttaacggcataaa

SEQ ID NO: 1160 - DNA, 200 bp, Euphorbia heterophylla
atcacattttgaattaggattggaggaaccggtgtagatgttcgaagcaagtcaagggtaattcggcattttgaatatttcggcgaatcgataagtttatttatttgtacggtttttgatttattgttgacttttcgtgtttttcagacaatctcgaagccagttgaacatccatccgagcttccgaagtggaactacga

SEQ ID NO: 1161 - DNA, 200 bp, Euphorbia heterophylla
tcgtagttccacttcggaagctcggatggatgttcaactggcttcgagattgtctgaaaaacacgaaaagtcaacaataaatcaaaaaccgtacaaataaataaacttatcgattcgccgaaatattcaaaatgccgaattacccttgacttgcttcgaacatctacaccggttcctccaatcctaattcaaaatgtgat

SEQ ID NO: 1162 - DNA, 200 bp, Euphorbia heterophylla
ccgagcttccgaagtggaactacgatggatcgagtaccggacaagcacctggcgaggatagtgaagttattctatagtaagatcacgcaaaaaaaactctttgcaatttattcttatttacgataagcatagttttgactttatgttttttccagtcctcaggctatctttaaggacccattccgtgggggcaacaatat

SEQ ID NO: 1163 - DNA, 200 bp, Euphorbia heterophylla
atattgttgcccccacggaatgggtccttaaagatagcctgaggactggaaaaaacataaagtcaaaactatgcttatcgtaaataagaataaattgcaaagagttttttttgcgtgatcttactatagaataacttcactatcctcgccaggtgcttgtccggtactcgatccatcgtagttccacttcggaagctcgg

SEQ ID NO: 1164 - DNA, 200 bp, Euphorbia heterophylla
acccattccgtgggggcaacaatatcttggtaagtttttctatcaaatagctagcaaattggtcctgaaatttagtccatattttgtttgcgtggctaaattttttgggctttttctaaaatcccaagatttttagattttttttataaagtatatcctaaacataatttattctaaaaatacaagattttaaattttaa

SEQ ID NO: 1165 - DNA, 200 bp, Euphorbia heterophylla
ttaaaatttaaaatcttgtatttttagaataaattatgtttaggatatactttataaaaaaaatctaaaaatcttgggattttagaaaaagcccaaaaaatttagccacgcaaacaaaatatggactaaatttcaggaccaatttgctagctatttgatagaaaaacttaccaagatattgttgcccccacggaatgggt

SEQ ID NO: 1166 - DNA, 200 bp, Euphorbia heterophylla
aaaaatacaagattttaaattttaaattttgagaataccttctttttggtcataatagattttatacctttttatatcttgatttatgtatattataccttcaattaaaatataccgtataagtcaattaccaaagctaaaaaaataaaatcattataaaatgcaaaataaaatcggtataatatcgaagttagaaaaaa

SEQ ID NO: 1167 - DNA, 200 bp, Euphorbia heterophylla
ttttttctaacttcgatattataccgattttattttgcattttataatgattttatttttttagctttggtaattgacttatacggtatattttaattgaaggtataatatacataaatcaagatataaaaaggtataaaatctattatgaccaaaaagaaggtattctcaaaatttaaaatttaaaatcttgtattttt

SEQ ID NO: 1168 - DNA, 200 bp, Euphorbia heterophylla
ggtataatatcgaagttagaaaaaacatcaaaaccattacaaagaacagaatcaaagaatataatacatattataccagatattagaaaaggtgtaatacatattatacgcaattataaaaaggtataatatctataataccaaaaatcttgtatttttagaataaaatattatttaagatatttttttgcaaaaaaaat

SEQ ID NO: 1169 - DNA, 200 bp, Euphorbia heterophylla
attttttttgcaaaaaaatatcttaaataatattttattctaaaaatacaagatttttggtattatagatattatacctttttataattgcgtataatatgtattacaccttttctaatatctggtataatatgtattatattctttgattctgttctttgtaatggttttgatgttttttctaacttcgatattatacc

SEQ ID NO: 1170 - DNA, 200 bp, Euphorbia heterophylla
taagatatttttttgcaaaaaaaatctaaaaatcttgtgtttgttacaatttcccaaatttttttcgttattgtgtgaaggtcatttgtgacgcatataccccagctggcgagccaatcccaaccaataagcgccatcgagctgccgaaattttcagtaaccagaaggttattgatgaagtaccatggtaaaaactcttc

SEQ ID NO: 1171 - DNA, 200 bp, Euphorbia heterophylla
gaagagtttttaccatggtacttcatcaataaccttctggttactgaaaatttcggcagctcgatggcgcttattggttgggattggctcgccagctggggtatatgcgtcacaaatgaccttcacacaataacgaaaaaaatttgggaaattgtaacaaacacaagatttttagattttttttgcaaaaaaatatctta

SEQ ID NO: 1172 - DNA, 200 bp, Euphorbia heterophylla
tgaagtaccatggtaaaaactcttcagttactttttttatttccgggtttttactgtttgaccaaaagattcgatttttaatcatttgaaaaggtatgggatcgagcaagagtacaccttgcttcaaacaaatgtgaattggcctttgggttggccagttggaggctatcctggtcctcaggtaaaattgtttatgagct

SEQ ID NO: 1173 - DNA, 200 bp, Euphorbia heterophylla
agctcataaacaattttacctgaggaccaggatagcctccaactggccaacccaaaggccaattcacatttgtttgaagcaaggtgtactcttgctcgatcccataccttttcaaatgattaaaaatcgaatcttttggtcaaacagtaaaaacccggaaataaaaaaagtaactgaagagtttttaccatggtacttca

SEQ ID NO: 1174 - DNA, 200 bp, Euphorbia heterophylla
cctcaggtaaaattgtttatgagctctaagttaagttccttatcggtttttttttcgaacttgggcagttaaattacgtttgggtccttttttcagggtccttactattgtgcagctggggcggataagtcttttggccgtgacatatcggacgctcattataaggcttgtttatatgccggaattaacattagtggcac

SEQ ID NO: 1175 - DNA, 200 bp, Euphorbia heterophylla
gtgccactaatgttaattccggcatataaacaagccttataatgagcgtccgatatgtcacggccaaaagacttatccgccccagctgcacaatagtaaggaccctgaaaaaaggacccaaacgtaatttaactgcccaagttcgaaaaaaaaaccgataaggaacttaacttagagctcataaacaattttacctgagg

SEQ ID NO: 1176 - DNA, 200 bp, Euphorbia heterophylla
ttttgttggttggaaggaatgttttctagcttctatttcgctttcgtatggtaacttattactttaaataaaggacaagaaaatgatttttgattttggaaagtatcgagaaatgttttttgaaagctattttcttatgaatatactaaaaatgtgatctaatctttattaaataatgccatacttgtccactgaaaata

SEQ ID NO: 1177 - DNA, 200 bp, Euphorbia heterophylla
tattttcagtggacaagtatggcattatttaataaagattagatcacatttttagtatattcataagaaaatagctttcaaaaaacatttctcgatactttccaaaatcaaaaatcattttcttgtcctttatttaaagtaataagttaccatacgaaagcgaaatagaagctagaaaacattccttccaaccaacaaaa

SEQ ID NO: 1178 - DNA, 200 bp, Euphorbia heterophylla
atgccatacttgtccactgaaaatatatttatttgggggtcaactgttaattaattcttgatcatggttgtaacagcccacaagctatcttcagagatccattcaggaggggaaacaatatccttgtgagtttcgttgttacctatttcgttcgtgacatctgttagcatcattggctgttagtaggctaattcagtaat

SEQ ID NO: 1179 - DNA, 200 bp, Euphorbia heterophylla
attactgaattagcctactaacagccaatgatgctaacagatgtcacgaacgaaataggtaacaacgaaactcacaaggatattgtttcccctcctgaatggatctctgaagatagcttgtgggctgttacaaccatgatcaagaattaattaacagttgacccccaaataaatatattttcagtggacaagtatggcat

SEQ ID NO: 1180 - DNA, 200 bp, Kochia scoparia
actaaaacaatgagagaagatggtggtttcgaagtgataaaaaaagcgattttgaatctttcattacgccataaggagcatattagtgcatatggagaaggcaatgagagaaggttgactggaaagcatgaaactgccagcatcgattcattctcttggggtgttgccaaccgtggttgctcaatccgtgtgggccgtga

SEQ ID NO: 1181 - DNA, 200 bp, Kochia scoparia
tcacggcccacacggattgagcaaccacggttggcaacaccccaagagaatgaatcgatgctggcagtttcatgctttccagtcaaccttctctcattgccttctccatatgcactaatatgctccttatggcgtaatgaaagattcaaaatcgctttttttatcacttcgaaaccaccatcttctctcattgttttagt

SEQ ID NO: 1182 - DNA, 200 bp, Kochia scoparia
ataaagggaatttttaatttttttatatttaaatgctaaattaggtctcaaaatcttaggataaaaaatggatggaaagaaagggagagaatcctaactccgtatacgtatgaactttaaacattaaaaaaaaattgattaaagtttgtctaaaataatttccttcttttaaaaatgtgtaatgttgtttggatgcaagt

SEQ ID NO: 1183 - DNA, 200 bp, Kochia scoparia
acttgcatccaaacaacattacacatttttaaaagaaggaaattattttagacaaactttaatcaatttttttttaatgtttaaagttcatacgtatacggagttaggattctctccctttctttccatccattttttatcctaagattttgagacctaatttagcatttaaatataaaaaaattaaaaattccctttat

SEQ ID NO: 1184 - DNA, 200 bp, Kochia scoparia
tgtgtaatgttgtttggatgcaagtaataaaaaacaaagaaagtatatacgaaagtatgtagactggtgtattggtggagggagatttaaatattgtgttagtttataaaaagattgctttattacttaggagactccaaaagattgctttatttacttagctagatttgttctaaaatatttcatcatttaataatcca

SEQ ID NO: 1185 - DNA, 200 bp, Kochia scoparia
tggattattaaatgatgaaatattttagaacaaatctagctaagtaaataaagcaatcttttggagtctcctaagtaataaagcaatctttttataaactaacacaatatttaaatctccctccaccaatacaccagtctacatactttcgtatatactttctttgttttttattacttgcatccaaacaacattacaca

SEQ ID NO: 1186 - DNA, 200 bp, Kochia scoparia
aaatatttcatcatttaataatccaaacccctttctctttcctctccttagacggcgtgggcccactcgacggacggcgttggtccactcgacggacggagttggaccactcgacggacggcgtctctgtgtctatctctcttgtgttgcgctgctgttattcttgcgttgcgttgctttgctttgctactgctgtgtgg

SEQ ID NO: 1187 - DNA, 200 bp, Kochia scoparia
ccacacagcagtagcaaagcaaagcaacgcaacgcaagaataacagcagcgcaacacaagagagatagacacagagacgccgtccgtcgagtggtccaactccgtccgtcgagtggaccaacgccgtccgtcgagtgggcccacgccgtctaaggagaggaaagagaaaggggtttggattattaaatgatgaaatattt

SEQ ID NO: 1188 - DNA, 200 bp, Kochia scoparia
gctttgctttgctactgctgtgtggttgctcgatcttaatatcattgttaggatttcggtttttttaaggtattctacttctctcagtctctctcctcatcttcccccaattctgtgttgaattctttttaatgtttgaattattttgctagagttttgtgtgaattttgttggaattatttatgagttgtgtttcaatt

SEQ ID NO: 1189 - DNA, 200 bp, Kochia scoparia
aattgaaacacaactcataaataattccaacaaaattcacacaaaactctagcaaaataattcaaacattaaaaagaattcaacacagaattgggggaagatgaggagagagactgagagaagtagaataccttaaaaaaaccgaaatcctaacaatgatattaagatcgagcaaccacacagcagtagcaaagcaaagc

SEQ ID NO: 1190 - DNA, 200 bp, Kochia scoparia
attatttatgagttgtgtttcaatttctattgtttgtgaggttacacattattgtttggttttgggtgattttgggggcagaattattgatgattctggggctgaatttaaagaccaacaaagaactataatataataatcaaactgcaacaaacaaagcataacacacattggaaatcaagtttggtaatgggcattta

SEQ ID NO: 1191 - DNA, 200 bp, Kochia scoparia
taaatgcccattaccaaacttgatttccaatgtgtgttatgctttgtttgttgcagtttgattattatattatagttctttgttggtctttaaattcagccccagaatcatcaataattctgcccccaaaatcacccaaaaccaaacaataatgtgtaacctcacaaacaatagaaattgaaacacaactcataaataat

SEQ ID NO: 1192 - DNA, 200 bp, Kochia scoparia
aatcaagtttggtaatgggcatttaacacacattgagaatttgtaccttgaattggacaaaaatcagaagataattgtccaacattatcacaacaggaacaactggtatacagtaattaaatcaattgatacggtaaatcgaggaggtcccctcgataattggaaatggacaacgaaaaccttatctaaaaagttggaac

SEQ ID NO: 1193 - DNA, 200 bp, Kochia scoparia
gttccaactttttagataaggttttcgttgtccatttccaattatcgaggggacctcctcgatttaccgtatcaattgatttaattactgtataccagttgttcctgttgtgataatgttggacaattatcttctgatttttgtccaattcaaggtacaaattctcaatgtgtgttaaatgcccattaccaaacttgatt

SEQ ID NO: 1194 - DNA, 200 bp, Kochia scoparia
aaaaccttatctaaaaagttggaaccctttttttaaaaaaaaatgtttgatcaaatttagtccagagattcttttaaaacacaattttcaccactcaatcacaaacacccctatctactatggaaaagccatgctcagccatttttcctcctcttttcttttcaacccactatttgccctttcccattctccaaaattat

SEQ ID NO: 1195 - DNA, 200 bp, Kochia scoparia
ataattttggagaatgggaaagggcaaatagtgggttgaaaagaaaagaggaggaaaaatggctgagcatggcttttccatagtagataggggtgtttgtgattgagtggtgaaaattgtgttttaaaagaatctctggactaaatttgatcaaacatttttttttaaaaaaagggttccaactttttagataaggtttt

SEQ ID NO: 1196 - DNA, 200 bp, Kochia scoparia
gccctttcccattctccaaaattatattatcaatattattctttctatatactacaaacactatcttacatttggtcactctcttctctttctctctcctggcagttgactctctccattcccaattgattagcaacaaggtagtatctacattttcccacccatgtttctttcttgcattcaattcttgttactctttc

SEQ ID NO: 1197 - DNA, 200 bp, Kochia scoparia
gaaagagtaacaagaattgaatgcaagaaagaaacatgggtgggaaaatgtagatactaccttgttgctaatcaattgggaatggagagagtcaactgccaggagagagaaagagaagagagtgaccaaatgtaagatagtgtttgtagtatatagaaagaataatattgataatataattttggagaatgggaaagggc

SEQ ID NO: 1198 - DNA, 200 bp, Kochia scoparia
tgcattcaattcttgttactctttcttgtgctacttcactatcttggcaattgtgatctcgtcattaaatgcattgctgtctcatcatcgcatttatttcatctctcatatgagttaatgagtactacttgctattattgacaatgtataaggtgatctactttgtttctaataagtcactgctattctgtgctaaacta

SEQ ID NO: 1199 - DNA, 200 bp, Kochia scoparia
tagtttagcacagaatagcagtgacttattagaaacaaagtagatcaccttatacattgtcaataatagcaagtagtactcattaactcatatgagagatgaaataaatgcgatgatgagacagcaatgcatttaatgacgagatcacaattgccaagatagtgaagtagcacaagaaagagtaacaagaattgaatgca

SEQ ID NO: 1200 - DNA, 200 bp, Kochia scoparia
gtcactgctattctgtgctaaactagatttatacttatttacaactgatgactgctgatttagtgatttagtgatttagtgatttagatcgtactttctttgttttgctcgattttcggacgtcgattcgatatatacagatttgatgaacagcattgttgccaatgatcagtagtagtaatgttgttgaaagctttcag

SEQ ID NO: 1201 - DNA, 200 bp, Kochia scoparia
ctgaaagctttcaacaacattactactactgatcattggcaacaatgctgttcatcaaatctgtatatatcgaatcgacgtccgaaaatcgagcaaaacaaagaaagtacgatctaaatcactaaatcactaaatcactaaatcagcagtcatcagttgtaaataagtataaatctagtttagcacagaatagcagtgac

SEQ ID NO: 1202 - DNA, 200 bp, Kochia scoparia
tagtaatgttgttgaaagctttcagttatagtgatatcttccatctgctagttttttttagaggaaatcagtttttgctaggaggaaaaagggaattactaaaaaaaattataaatgttctttcaaaatttgagtgaagaaaataatggttattaaacactaattttgagctgaaagaatatgatcagatgcttttgtat

SEQ ID NO: 1203 - DNA, 200 bp, Kochia scoparia
atacaaaagcatctgatcatattctttcagctcaaaattagtgtttaataaccattattttcttcactcaaattttgaaagaacatttataattttttttagtaattccctttttcctcctagcaaaaactgatttcctctaaaaaaaactagcagatggaagatatcactataactgaaagctttcaacaacattacta

SEQ ID NO: 1204 - DNA, 200 bp, Kochia scoparia
agaatatgatcagatgcttttgtattctaatgtcttgaatcctaatatgcacctttaaaaccttttgtttttcaatgaaaaagtaaggaaaaagattatttgcattagtggcacgagtctaatctaataaccgtggtttcgtctcttctctttcaaaaattggaaaagtgttgatgtcattttctaacatttcctactaa

SEQ ID NO: 1205 - DNA, 200 bp, Kochia scoparia
ttagtaggaaatgttagaaaatgacatcaacacttttccaatttttgaaagagaagagacgaaaccacggttattagattagactcgtgccactaatgcaaataatctttttccttactttttcattgaaaaacaaaaggttttaaaggtgcatattaggattcaagacattagaatacaaaagcatctgatcatattct

SEQ ID NO: 1206 - DNA, 200 bp, Kochia scoparia
gtcattttctaacatttcctactaagtactaaccaaaacaaggttttctttccactaatagaattttcctttaccacatttatacagtataaaaatctctaactttagactttagagcatactatcacatcatggtgttgtcatagtatattcatattagagcaggtttagccccaagtctgaagacttgggatgaaatt

SEQ ID NO: 1207 - DNA, 200 bp, Kochia scoparia
aatttcatcccaagtcttcagacttggggctaaacctgctctaatatgaatatactatgacaacaccatgatgtgatagtatgctctaaagtctaaagttagagatttttatactgtataaatgtggtaaaggaaaattctattagtggaaagaaaaccttgttttggttagtacttagtaggaaatgttagaaaatgac

SEQ ID NO: 1208 - DNA, 200 bp, Kochia scoparia
aagtctgaagacttgggatgaaattacctttattgtcttaagatttagatttaagattttcccatttttcttttaaaatcttagccagatctcaagttgatttcaaggctcaacttaagacttgaaacacgggacccaccctaatttaataatgtttgttttcatatagataacataaagagataaaaaaaaagtaaaat

SEQ ID NO: 1209 - DNA, 200 bp, Kochia scoparia
attttactttttttttatctctttatgttatctatatgaaaacaaacattattaaattagggtgggtcccgtgtttcaagtcttaagttgagccttgaaatcaacttgagatctggctaagattttaaaagaaaaatgggaaaatcttaaatctaaatcttaagacaataaaggtaatttcatcccaagtcttcagactt

SEQ ID NO: 1210 - DNA, 200 bp, Kochia scoparia
taaagagataaaaaaaaagtaaaatatcatggtatatatttaagactaggagtcttagggctaaagtgataaagttggacaagttttatggagtttaagaaaacattattttttgtgggaaccactaaaaaatgatgttacacccaagttttaagacttggtgctaagcttgctgttacaaattggtttcaatcataaca

SEQ ID NO: 1211 - DNA, 200 bp, Kochia scoparia
tgttatgattgaaaccaatttgtaacagcaagcttagcaccaagtcttaaaacttgggtgtaacatcattttttagtggttcccacaaaaaataatgttttcttaaactccataaaacttgtccaactttatcactttagccctaagactcctagtcttaaatatataccatgatattttactttttttttatctcttta

SEQ ID NO: 1212 - DNA, 200 bp, Kochia scoparia
ttacaaattggtttcaatcataacagttattccttatctttgacttggaatttagtccaaatcttttgttgtggtgtactggtgtcgaggatacaacatggatacctaacgggaagaaaagagtttttgcaacttatattgtctgtctgtgtttaatgttgccacttctacgggaattctggtttctgtaatccaggatt

SEQ ID NO: 1213 - DNA, 200 bp, Kochia scoparia
aatcctggattacagaaaccagaattcccgtagaagtggcaacattaaacacagacagacaatataagttgcaaaaactcttttcttcccgttaggtatccatgttgtatcctcgacaccagtacaccacaacaaaagatttggactaaattccaagtcaaagataaggaataactgttatgattgaaaccaatttgtaa

SEQ ID NO: 1214 - DNA, 200 bp, Kochia scoparia
attctggtttctgtaatccaggattaaagagctgtcagctgttgtactgtaaattgtttgtgtaatagttttaatttttgtagggaaaggaccaaatatggcccagattctcgctcctagcatgcaatgtcagttgaaattctcaaaaagctcattaagctcgctagcatcgaacacgtggacctccattttgctaaaag

SEQ ID NO: 1215 - DNA, 200 bp, Kochia scoparia
cttttagcaaaatggaggtccacgtgttcgatgctagcgagcttaatgagctttttgagaatttcaactgacattgcatgctaggagcgagaatctgggccatatttggtcctttccctacaaaaattaaaactattacacaaacaatttacagtacaacagctgacagctctttaatcctggattacagaaaccagaat

SEQ ID NO: 1216 - DNA, 200 bp, Kochia scoparia
acgtggacctccattttgctaaaaggaaaccaaaagagatcgcttcattgctcaactaagttcaaggtatccgctgctctcaaatctgatgatggtactatcaacagggtagagcagctactcaatttggatgtcactccatacactgacaagattattgctgaatacatatggtatagtttcccattctgattttggca

SEQ ID NO: 1217 - DNA, 200 bp, Kochia scoparia
tgccaaaatcagaatgggaaactataccatatgtattcagcaataatcttgtcagtgtatggagtgacatccaaattgagtagctgctctaccctgttgatagtaccatcatcagatttgagagcagcggataccttgaacttagttgagcaatgaagcgatctcttttggtttccttttagcaaaatggaggtccacgt

SEQ ID NO: 1218 - DNA, 200 bp, Kochia scoparia
atagtttcccattctgattttggcatctttatcgagggttattttttctcaaatatgcttgatgaggttatggtagaatcaacatattagggctttacttgcatggttgtattaggctcttttgttgtagaaaagcctgcttggtaattcagtgtccaggtgttgatggaactaattgaattatgattgttcattggaat

SEQ ID NO: 1219 - DNA, 200 bp, Kochia scoparia
attccaatgaacaatcataattcaattagttccatcaacacctggacactgaattaccaagcaggcttttctacaacaaaagagcctaatacaaccatgcaagtaaagccctaatatgttgattctaccataacctcatcaagcatatttgagaaaaaataaccctcgataaagatgccaaaatcagaatgggaaactat

SEQ ID NO: 1220 - DNA, 200 bp, Kochia scoparia
ttgaattatgattgttcattggaataggattggaggatctgggattgatgttcgcagtaaatccagggtatagtaacatccattctgtagcttgattattaaccacctattagatgctgactaatgttttcttaataataccagacaatctcaagacctattgaggatccatctgaacttcccaaatggaactttgatgg

SEQ ID NO: 1221 - DNA, 200 bp, Kochia scoparia
ccatcaaagttccatttgggaagttcagatggatcctcaataggtcttgagattgtctggtattattaagaaaacattagtcagcatctaataggtggttaataatcaagctacagaatggatgttactataccctggatttactgcgaacatcaatcccagatcctccaatcctattccaatgaacaatcataattcaa

SEQ ID NO: 1222 - DNA, 200 bp, Kochia scoparia
aacttcccaaatggaactttgatgggtcaagcactggacaagcgccgggagaagacagtgaagtaatcttatagtaagatcctgttacatctatgaatcttcatcattttccccataaattcattattcattatttccgagtctttcttttattctcgtcttttaatgactgatcattagtcattgttgtcttgcatttc

SEQ ID NO: 1223 - DNA, 200 bp, Kochia scoparia
gaaatgcaagacaacaatgactaatgatcagtcattaaaagacgagaataaaagaaagactcggaaataatgaataatgaatttatggggaaaatgatgaagattcatagatgtaacaggatcttactataagattacttcactgtcttctcccggcgcttgtccagtgcttgacccatcaaagttccatttgggaagtt

SEQ ID NO: 1224 - DNA, 200 bp, Kochia scoparia
attagtcattgttgtcttgcatttcttctgcaatagccctcaagcaatttttaaggatccttttcgtggtggtaacaatatcttggtgagtttgatagagcatatgaatcggttattctaaagttatagtgtttcttataaatagtaaatttatttgttaaggttgcaaccataatttatgatttgtaaatctaggtgat

SEQ ID NO: 1225 - DNA, 200 bp, Kochia scoparia
atcacctagatttacaaatcataaattatggttgcaaccttaacaaataaatttactatttataagaaacactataactttagaataaccgattcatatgctctatcaaactcaccaagatattgttaccaccacgaaaaggatccttaaaaattgcttgagggctattgcagaagaaatgcaagacaacaatgactaat

SEQ ID NO: 1226 - DNA, 200 bp, Kochia scoparia
tttatgatttgtaaatctaggtgatctgtgatgcatacacaccagcaggtgaacccatcccaactaataaacgacacaaagctgcacagatcttcagcaaccaaaaggttgtttctgaggttccatggtatgaagttccttgtactgataaaatccatttatgaattgttaataaccactttgcatttgaacattaaatt

SEQ ID NO: 1227 - DNA, 200 bp, Kochia scoparia
aatttaatgttcaaatgcaaagtggttattaacaattcataaatggattttatcagtacaaggaacttcataccatggaacctcagaaacaaccttttggttgctgaagatctgtgcagctttgtgtcgtttattagttgggatgggttcacctgctggtgtgtatgcatcacagatcacctagatttacaaatcataaa

SEQ ID NO: 1228 - DNA, 200 bp, Kochia scoparia
ccactttgcatttgaacattaaattttgtgtacaaagtttcctattataggaaggataattaattaatcataattgggagggtgaaattgagaagaaaaaagaggattgcatgaacagtccaatgcattttgttgctgacatgagaggcaatttggggctttgtagagctggctggattgtggaatgtaatcgacaggaa

SEQ ID NO: 1229 - DNA, 200 bp, Kochia scoparia
ttcctgtcgattacattccacaatccagccagctctacaaagccccaaattgcctctcatgtcagcaacaaaatgcattggactgttcatgcaatcctcttttttcttctcaatttcaccctcccaattatgattaattaattatccttcctataataggaaactttgtacacaaaatttaatgttcaaatgcaaagtgg

SEQ ID NO: 1230 - DNA, 200 bp, Kochia scoparia
gattgtggaatgtaatcgacaggaaactgatgactgaccactgtgaatatgatctgttatgacacatttcatttttcgaatagaggaatttcattgccaggttgacctataacagtataactatgtcagaacagagcttctcgatttcaaaattgtgttggcttttcattttcaaataatcagaagagactcatcttttg

SEQ ID NO: 1231 - DNA, 200 bp, Kochia scoparia
caaaagatgagtctcttctgattatttgaaaatgaaaagccaacacaattttgaaatcgagaagctctgttctgacatagttatactgttataggtcaacctggcaatgaaattcctctattcgaaaaatgaaatgtgtcataacagatcatattcacagtggtcagtcatcagtttcctgtcgattacattccacaatc

SEQ ID NO: 1232 - DNA, 200 bp, Kochia scoparia
ataatcagaagagactcatcttttgttttctgtgttatcgttctactttaagcttttatactctttgttttagtcatttaatcatatttttacaggtttggaatagagcaggaatacacacttcttcaaccaaatgttaattggcccttgggatggcctgtaggagcttatcccggtcctcaagtatgttattcagttgc

SEQ ID NO: 1233 - DNA, 200 bp, Kochia scoparia
gcaactgaataacatacttgaggaccgggataagctcctacaggccatcccaagggccaattaacatttggttgaagaagtgtgtattcctgctctattccaaacctgtaaaaatatgattaaatgactaaaacaaagagtataaaagcttaaagtagaacgataacacagaaaacaaaagatgagtctcttctgattat

SEQ ID NO: 1234 - DNA, 200 bp, Kochia scoparia
gtcctcaagtatgttattcagttgctcctatttcatattcattttgtccaatgaagatgctttgttgtgttatagattagaatcgttttgttacgcaaaatgattttttttcgcattttctagggtccatattattgtggtgttggtgctgaaaaatcttttggacgtgacatttctgatgctcactataaagcttgcct

SEQ ID NO: 1235 - DNA, 200 bp, Kochia scoparia
aggcaagctttatagtgagcatcagaaatgtcacgtccaaaagatttttcagcaccaacaccacaataatatggaccctagaaaatgcgaaaaaaaatcattttgcgtaacaaaacgattctaatctataacacaacaaagcatcttcattggacaaaatgaatatgaaataggagcaactgaataacatacttgaggac

SEQ ID NO: 1236 - DNA, 200 bp, Kochia scoparia
ctgatgctcactataaagcttgcctgtatgctggaattaacatcagtggcaccaatggggaagttatgcctggccaggtattcccttacatcattctagtatgtcttccagtcataaatttgctttgaatcttgtaactcaatagctgtatatccacttgtacctacagtgggaattccaggttggtcctagtgttggga

SEQ ID NO: 1237 - DNA, 200 bp, Kochia scoparia
tcccaacactaggaccaacctggaattcccactgtaggtacaagtggatatacagctattgagttacaagattcaaagcaaatttatgactggaagacatactagaatgatgtaagggaatacctggccaggcataacttccccattggtgccactgatgttaattccagcatacaggcaagctttatagtgagcatcag

SEQ ID NO: 1238 - DNA, 200 bp, Kochia scoparia
ttccaggttggtcctagtgttgggattgaagcaggagatcatatctggtgtgccagatatattcttgaggtattctcctgcaatttgtatgttcccctctgcgcttatcagttacaactatagttttgtaatttgctgccctatcgttttattattcattatttttctacttgaattctgcttgaaagataataagctac

SEQ ID NO: 1239 - DNA, 200 bp, Kochia scoparia
gtagcttattatctttcaagcagaattcaagtagaaaaataatgaataataaaacgatagggcagcaaattacaaaactatagttgtaactgataagcgcagaggggaacatacaaattgcaggagaatacctcaagaatatatctggcacaccagatatgatctcctgcttcaatcccaacactaggaccaacctggaa

SEQ ID NO: 1240 - DNA, 200 bp, Kochia scoparia
atggcccagattctcgctcctagcatgcaatgtcagttgaaattctcaaaaagctcattaagctcgctagcatcgaacacgtggacctccattttgctaaaaggaaaccaaaagagatcgcttcattgctcaactaagttcaaggtatccgctgctctcaaatctgatgatggtactatcaacagggtagagcagctact

SEQ ID NO: 1241 - DNA, 200 bp, Kochia scoparia
agtagctgctctaccctgttgatagtaccatcatcagatttgagagcagcggataccttgaacttagttgagcaatgaagcgatctcttttggtttccttttagcaaaatggaggtccacgtgttcgatgctagcgagcttaatgagctttttgagaatttcaactgacattgcatgctaggagcgagaatctgggccat

SEQ ID NO: 1242 - DNA, 200 bp, Kochia scoparia
ctatcaacagggtagagcagctactcaatttggatgtcactccatacactgacaagattattgctgaatacatatggattggaggatctgggattgatgttcgcagtaaatccaggacaatctcaagacctattgaggatccatctgaacttcccaaatggaactttgatgggtcaagcactggacaagcgccgggagaa

SEQ ID NO: 1243 - DNA, 200 bp, Kochia scoparia
ttctcccggcgcttgtccagtgcttgacccatcaaagttccatttgggaagttcagatggatcctcaataggtcttgagattgtcctggatttactgcgaacatcaatcccagatcctccaatccatatgtattcagcaataatcttgtcagtgtatggagtgacatccaaattgagtagctgctctaccctgttgatag

SEQ ID NO: 1244 - DNA, 200 bp, Kochia scoparia
aagcactggacaagcgccgggagaagacagtgaagtaatcttataccctcaagcaatttttaaggatccttttcgtggtggtaacaatatcttggtgatctgtgatgcatacacaccagcaggtgaacccatcccaactaataaacgacacaaagctgcacagatcttcagcaaccaaaaggttgtttctgaggttccat

SEQ ID NO: 1245 - DNA, 200 bp, Kochia scoparia
atggaacctcagaaacaaccttttggttgctgaagatctgtgcagctttgtgtcgtttattagttgggatgggttcacctgctggtgtgtatgcatcacagatcaccaagatattgttaccaccacgaaaaggatccttaaaaattgcttgagggtataagattacttcactgtcttctcccggcgcttgtccagtgctt

SEQ ID NO: 1246 - DNA, 200 bp, Kochia scoparia
caaaaggttgtttctgaggttccatggtttggaatagagcaggaatacacacttcttcaaccaaatgttaattggcccttgggatggcctgtaggagcttatcccggtcctcaaggtccatattattgtggtgttggtgctgaaaaatcttttggacgtgacatttctgatgctcactataaagcttgcctgtatgctgg

SEQ ID NO: 1247 - DNA, 200 bp, Kochia scoparia
ccagcatacaggcaagctttatagtgagcatcagaaatgtcacgtccaaaagatttttcagcaccaacaccacaataatatggaccttgaggaccgggataagctcctacaggccatcccaagggccaattaacatttggttgaagaagtgtgtattcctgctctattccaaaccatggaacctcagaaacaaccttttg

SEQ ID NO: 1248 - DNA, 200 bp, Kochia scoparia
atgtcgcttctctcagatctcattaaccttgatctttctgattctactgataagatcattgctgagtacatatggattggtggatctggtatggacatgagaagtaaagctagaacattggaggggcctgtttctgatccgaaaaagcttccaaaatggaattatgatggatccagcactggtcaagctcctggtgaaga

SEQ ID NO: 1249 - DNA, 200 bp, Kochia scoparia
tcttcaccaggagcttgaccagtgctggatccatcataattccattttggaagctttttcggatcagaaacaggcccctccaatgttctagctttacttctcatgtccataccagatccaccaatccatatgtactcagcaatgatcttatcagtagaatcagaaagatcaaggttaatgagatctgagagaagcgacat

SEQ ID NO: 1250 - DNA, 200 bp, Kochia scoparia
gcactggtcaagctcctggtgaagacagtgaagttattctctacccacaagctatcttcagagatccattcaggaggggaaacaatatccttgttatgtgtgatgcctacaccccacaaggagagccgatcccaactaacaatagatgcaatgccgaaaagatattcagcaacccagaagttgccgctgaagtaccttgg

SEQ ID NO: 1251 - DNA, 200 bp, Kochia scoparia
ccaaggtacttcagcggcaacttctgggttgctgaatatcttttcggcattgcatctattgttagttgggatcggctctccttgtggggtgtaggcatcacacataacaaggatattgtttcccctcctgaatggatctctgaagatagcttgtgggtagagaataacttcactgtcttcaccaggagcttgaccagtgc

SEQ ID NO: 1252 - DNA, 200 bp, Kochia scoparia
agaagttgccgctgaagtaccttggtatggtatcgagcaagaatatactttactgcagaaggatgtaaactggcccgttggctggcctttaggcggctttcctggtccacagggcccatactactgtggtgttggtgctgataaagctttcggaagggacatcgttgattcccactacaaagcctgcctttatgctggaa

SEQ ID NO: 1253 - DNA, 200 bp, Kochia scoparia
ttccagcataaaggcaggctttgtagtgggaatcaacgatgtcccttccgaaagctttatcagcaccaacaccacagtagtatgggccctgtggaccaggaaagccgcctaaaggccagccaacgggccagtttacatccttctgcagtaaagtatattcttgctcgataccataccaaggtacttcagcggcaacttct

SEQ ID NO: 1254 - DNA, 200 bp, Kochia scoparia
tacaaagcctgcctttatgctggaattaacatcagtggaattaacggtgaagtgatgccaggacagtgggaatttcaagttggtccatctgttggaatttctgctggtgatgaattgtgggtagctcgttacatattggagaggattactgaggttgctggagttgctctttcatttgatccaaaacccattccaggtga

SEQ ID NO: 1255 - DNA, 200 bp, Kochia scoparia
tcacctggaatgggttttggatcaaatgaaagagcaactccagcaacctcagtaatcctctccaatatgtaacgagctacccacaattcatcaccagcagaaattccaacagatggaccaacttgaaattcccactgtcctggcatcacttcaccgttaattccactgatgttaattccagcataaaggcaggctttgta

SEQ ID NO: 1256 - DNA, 200 bp, Kochia scoparia
ttgatccaaaacccattccaggtgattggaatggtgctggtgctcacacaaactacagcacaaaatctatgagggaagatggtggttacgaggtcattaagaaagctatcgaaaagcttgggttgaaacacgcggaacacatctctgcttatggtgagggaaatgaacgccgcctaactggtaaacatgaaacagccagc

SEQ ID NO: 1257 - DNA, 200 bp, Kochia scoparia
gctggctgtttcatgtttaccagttaggcggcgttcatttccctcaccataagcagagatgtgttccgcgtgtttcaacccaagcttttcgatagctttcttaatgacctcgtaaccaccatcttccctcatagattttgtgctgtagtttgtgtgagcaccagcaccattccaatcacctggaatgggttttggatcaa

SEQ ID NO: 1258 - DNA, 200 bp, Kochia scoparia
attaaggaatgtaaacagctcagatatattagacctaggcacctagcaagttattaaaaataatgagcatgctggttggtttttgtagcactaaaacaatgagagaagatggtggtttcgaagtgataaaaaaagcgattttgaatctttcattacgccataaggagcatattagtgcatatggagaaggcaatgagaga

SEQ ID NO: 1259 - DNA, 200 bp, Kochia scoparia
tctctcattgccttctccatatgcactaatatgctccttatggcgtaatgaaagattcaaaatcgctttttttatcacttcgaaaccaccatcttctctcattgttttagtgctacaaaaaccaaccagcatgctcattatttttaataacttgctaggtgcctaggtctaatatatctgagctgtttacattccttaat

SEQ ID NO: 1260 - DNA, 200 bp, Kochia scoparia
tgcatatggagaaggcaatgagagaaggttgactggaaagcatgaaactgccagcatcgattcattctcttgggtatagtcattatgccttccctttaattgacattatatttagagttatatttctcatgagagggtgttcaacaaacaatttgattatgtccagggtgttgccaaccgtggttgctcaatccgtgtgg

SEQ ID NO: 1261 - DNA, 200 bp, Kochia scoparia
ccacacggattgagcaaccacggttggcaacaccctggacataatcaaattgtttgttgaacaccctctcatgagaaatataactctaaatataatgtcaattaaagggaaggcataatgactatacccaagagaatgaatcgatgctggcagtttcatgctttccagtcaaccttctctcattgccttctccatatgca

SEQ ID NO: 1262 - DNA, 200 bp, Kochia scoparia
aaccgtggttgctcaatccgtgtgggccgtgatactgaaaaggaaggcaaaggtaacaatgctccttttgccataacttactgtcttacttgatatggcttgattttagagtcagggtttagaagactgtctatattttcctatgaatttacaatgtacaacgattgttggattttctcaaagttaattgttaacctaaa

SEQ ID NO: 1263 - DNA, 200 bp, Kochia scoparia
tttaggttaacaattaactttgagaaaatccaacaatcgttgtacattgtaaattcataggaaaatatagacagtcttctaaaccctgactctaaaatcaagccatatcaagtaagacagtaagttatggcaaaaggagcattgttacctttgccttccttttcagtatcacggcccacacggattgagcaaccacggtt

SEQ ID NO: 1264 - DNA, 200 bp, Kochia scoparia
tctcaaagttaattgttaacctaaaaacaaactagatgtctggttaaagaaaatgaacatggtacattttttatttatttttagatggttagagcttatcatccacttccgggagatcttgagattgattctcgcccttatggctttctaaacacccagtaaaaaacaaagctatataactgaactacctctatatgttt

SEQ ID NO: 1265 - DNA, 200 bp, Kochia scoparia
aaacatatagaggtagttcagttatatagctttgttttttactgggtgtttagaaagccataagggcgagaatcaatctcaagatctcccggaagtggatgataagctctaaccatctaaaaataaataaaaaatgtaccatgttcattttctttaaccagacatctagtttgtttttaggttaacaattaactttgaga

SEQ ID NO: 1266 - DNA, 200 bp, Kochia scoparia
ataactgaactacctctatatgtttaaattattaatattatattaatgcggaagtaacttgcttcaagttgcatcatagcatgcgatttggctactcacattgtttagggtgtcatctatggactatatggattccctcaaatgtctgtagctttacttcaattttcctatcaagacaacaaaaacaagttgattcctgc

SEQ ID NO: 1267 - DNA, 200 bp, Kochia scoparia
gcaggaatcaacttgtttttgttgtcttgataggaaaattgaagtaaagctacagacatttgagggaatccatatagtccatagatgacaccctaaacaatgtgagtagccaaatcgcatgctatgatgcaacttgaagcaagttacttccgcattaatataatattaataatttaaacatatagaggtagttcagttat

SEQ ID NO: 1268 - DNA, 200 bp, Kochia scoparia
acaacaaaaacaagttgattcctgctagacaatgtttaatttcttgaatataaattacttcgtaaaaaacacattgttaatgttatgatttaatactcatcaggatacttggaagatcgacgacctgcttcaaatatggacccatatgtggtaacaggtttgctagctgagaccacaatactctgggaacccacactcga

SEQ ID NO: 1269 - DNA, 200 bp, Kochia scoparia
tcgagtgtgggttcccagagtattgtggtctcagctagcaaacctgttaccacatatgggtccatatttgaagcaggtcgtcgatcttccaagtatcctgatgagtattaaatcataacattaacaatgtgttttttacgaagtaatttatattcaagaaattaaacattgtctagcaggaatcaacttgtttttgttgt

SEQ ID NO: 1270 - DNA, 200 bp, Kochia scoparia
caatactctgggaacccacactcgaggctgaggcattagcagctcaaaaacttgctctcaacgtgtaattccatccaagacaaacttaaacaagaataagaaatattgcatattgctgtcttaaacaactaagacaacttttcaactggatcgaacttgctatatttagtgattaggattgtttaaagctgtcaaagctt

SEQ ID NO: 1271 - DNA, 200 bp, Kochia scoparia
aagctttgacagctttaaacaatcctaatcactaaatatagcaagttcgatccagttgaaaagttgtcttagttgtttaagacagcaatatgcaatatttcttattcttgtttaagtttgtcttggatggaattacacgttgagagcaagtttttgagctgctaatgcctcagcctcgagtgtgggttcccagagtattg

SEQ ID NO: 1272 - DNA, 200 bp, Kochia scoparia
ggattgtttaaagctgtcaaagctttctccatatatcttagcttttctatgttttgttcattcaaggtttgatgaacaactatttgatatcgttgcccttaatgcgtttggtcccgttagttgccaaggccaattcgcatcgtgtttactactgagagtagttgaaatgcgaattttatttgtgttaatgtatttgttgc

SEQ ID NO: 1273 - DNA, 200 bp, Kochia scoparia
gcaacaaatacattaacacaaataaaattcgcatttcaactactctcagtagtaaacacgatgcgaattggccttggcaactaacgggaccaaacgcattaagggcaacgatatcaaatagttgttcatcaaaccttgaatgaacaaaacatagaaaagctaagatatatggagaaagctttgacagctttaaacaatcc

SEQ ID NO: 1274 - DNA, 200 bp, Kochia scoparia
ttatttgtgttaatgtatttgttgccagaaagtgtcttggaagttttgtcaatggtttattgatctacttgctcatgaagttggatgagacattttgcataatgtgtcttttcactcccaaacgtgtagtaatttgttcgacttcctcatatcactcgatatctttgtgcaaagtacaaaccctaagggattagggaatt

SEQ ID NO: 1275 - DNA, 200 bp, Kochia scoparia
aattccctaatcccttagggtttgtactttgcacaaagatatcgagtgatatgaggaagtcgaacaaattactacacgtttgggagtgaaaagacacattatgcaaaatgtctcatccaacttcatgagcaagtagatcaataaaccattgacaaaacttccaagacactttctggcaacaaatacattaacacaaataa

SEQ ID NO: 1276 - DNA, 200 bp, Kochia scoparia
acaaaccctaagggattagggaatttgttcttgttaacatttatgggaaaaaataatcaactttcgtgtttattttataaatagttgttgttgtgacaagtgtaacgagatatttgaaattagaggaactggggtgaacaggctccacttcaacaatgaatgttgattctccgacttgtgcttgtcaagacgttagaatc

SEQ ID NO: 1277 - DNA, 200 bp, Kochia scoparia
gattctaacgtcttgacaagcacaagtcggagaatcaacattcattgttgaagtggagcctgttcaccccagttcctctaatttcaaatatctcgttacacttgtcacaacaacaactatttataaaataaacacgaaagttgattattttttcccataaatgttaacaagaacaaattccctaatcccttagggtttgt

SEQ ID NO: 1278 - DNA, 200 bp, Kochia scoparia
ttgtgcttgtcaagacgttagaatcaatctccgattctctaagtctgaaagcttgagcatcctccggatcacctgaaacaaaagagataatctaatcgattatctcccttcgagtcaacacttctacaaaaaaaaaggtaatagagtaaatagagtgacttaaatgaaattttcctattttgttgaaaaagtaggtgagt

SEQ ID NO: 1279 - DNA, 200 bp, Kochia scoparia
actcacctactttttcaacaaaataggaaaatttcatttaagtcactctatttactctattacctttttttttgtagaagtgttgactcgaagggagataatcgattagattatctcttttgtttcaggtgatccggaggatgctcaagctttcagacttagagaatcggagattgattctaacgtcttgacaagcacaa

SEQ ID NO: 1280 - DNA, 200 bp, Kochia scoparia
tattttgttgaaaaagtaggtgagttaatgaatgaaagattgaggtgatgtaaaggaatctaacttgaaaaatgtgcaatcattgatgggtatttatattgtctatcaatgattgtcctcctaatggttatgcgacatgtggcatacgcctataggtcacttgttattggctagccttaatgatacgtgtcgtttaccgt

SEQ ID NO: 1281 - DNA, 200 bp, Kochia scoparia
acggtaaacgacacgtatcattaaggctagccaataacaagtgacctataggcgtatgccacatgtcgcataaccattaggaggacaatcattgatagacaatataaatacccatcaatgattgcacatttttcaagttagattcctttacatcacctcaatctttcattcattaactcacctactttttcaacaaaata

SEQ ID NO: 1282 - DNA, 135 bp, Kochia scoparia; identical to SEQ ID NO: 27

SEQ ID NO: 1283 - DNA, 135 bp, Kochia scoparia
tggaggagagagatgagattatgggttaattaggttgaattagaggttaattggaaaaaatactaacgatgttaactatttcacggtttttggtctcattaaggatatttgggctattttctctaatgtgagggg

SEQ ID NO: 1284 - DNA, 200 bp, Kochia scoparia
gtctattttatgagtaaaacaattcccgctaattttctccgggagatgcttgcaatctcaagaaatttaatggtgtgcaatctacatgtttgatggacaaagttttcccccaaattttaatgggacattgggtaggtgaaatactcaatcattagtgaagtacgtaattgcattctaaatcattaatttttttaactcct

SEQ ID NO: 1285 - DNA, 200 bp, Kochia scoparia
aggagttaaaaaaattaatgatttagaatgcaattacgtacttcactaatgattgagtatttcacctacccaatgtcccattaaaatttgggggaaaactttgtccatcaaacatgtagattgcacaccattaaatttcttgagattgcaagcatctcccggagaaaattagcgggaattgttttactcataaaatagac

SEQ ID NO: 1286 - DNA, 200 bp, Kochia scoparia
taaatcattaatttttttaactccttttgtgactaaataaatactttttttatcatttacaatttttactttgaccgtaatttttgacttatagataagaaaaaatatatttatcagaattcttgtcgaatttctctcaacttgtaattttttaaaatctaatgtttataatttttgcaaatacataattacagatatta

SEQ ID NO: 1287 - DNA, 200 bp, Kochia scoparia
taatatctgtaattatgtatttgcaaaaattataaacattagattttaaaaaattacaagttgagagaaattcgacaagaattctgataaatatattttttcttatctataagtcaaaaattacggtcaaagtaaaaattgtaaatgataaaaaaagtatttatttagtcacaaaaggagttaaaaaaattaatgattta

SEQ ID NO: 1288 - DNA, 200 bp, Kochia scoparia
tgcaaatacataattacagatattaatataaaaagttttatctcaacatgcgtgaaaagtacaattattataataattttgtcccaataaaatatttttgttgttaaagatttttaagaggttgaaaaagtagtatattttttttggctgaaaaagaatggagaataaacaatatcaaaacaataaataaagcagtatct

SEQ ID NO: 1289 - DNA, 200 bp, Kochia scoparia
agatactgctttatttattgttttgatattgtttattctccattctttttcagccaaaaaaaatatactactttttcaacctcttaaaaatctttaacaacaaaaatattttattgggacaaaattattataataattgtacttttcacgcatgttgagataaaactttttatattaatatctgtaattatgtatttgca

SEQ ID NO: 1290 - DNA, 200 bp, Kochia scoparia
caaaacaataaataaagcagtatctaaaagtagagtgtaatttgtgtagtccactctttaaaagagtaccaaaagttgaggacttcctcatcaattcatcataccattttatattggttgtttcagacatcactctatatattaggcgtcattttgcgactcatttcacgcatttcttgatcacattctcacaatatctt

SEQ ID NO: 1291 - DNA, 200 bp, Kochia scoparia
aagatattgtgagaatgtgatcaagaaatgcgtgaaatgagtcgcaaaatgacgcctaatatatagagtgatgtctgaaacaaccaatataaaatggtatgatgaattgatgaggaagtcctcaacttttggtactcttttaaagagtggactacacaaattacactctacttttagatactgctttatttattgttttg

SEQ ID NO: 1292 - DNA, 200 bp, Kochia scoparia
cttgatcacattctcacaatatctttctttctctcaatattttccataaacaatcacaacaacaacatgtcgcttctctcagatctcattaaccttgatctttctgattctactgataagatcattgctgagtacatatggtcagttctttattattgcacaccatcttttcgattttattacccaatgaataaagtttt

SEQ ID NO: 1293 - DNA, 200 bp, Kochia scoparia
aaaactttattcattgggtaataaaatcgaaaagatggtgtgcaataataaagaactgaccatatgtactcagcaatgatcttatcagtagaatcagaaagatcaaggttaatgagatctgagagaagcgacatgttgttgttgtgattgtttatggaaaatattgagagaaagaaagatattgtgagaatgtgatcaag

SEQ ID NO: 1294 - DNA, 200 bp, Kochia scoparia
tttattacccaatgaataaagttttattttttctgggtttttctcttttagcagaaagatttcattaacaacttaattcacaatgaaggatttcagcttttttagttatgaatagtttgatgaagaaaagtgatgggttgtatcttatatattttatctgtttgttcttaatatgggatattttccagtgttacaatatt

SEQ ID NO: 1295 - DNA, 200 bp, Kochia scoparia
aatattgtaacactggaaaatatcccatattaagaacaaacagataaaatatataagatacaacccatcacttttcttcatcaaactattcataactaaaaaagctgaaatccttcattgtgaattaagttgttaatgaaatctttctgctaaaagagaaaaacccagaaaaaataaaactttattcattgggtaataaa

SEQ ID NO: 1296 - DNA, 200 bp, Kochia scoparia
ggatattttccagtgttacaatattgcttatttgactagcaaaatatatttatcttatttttcattgaacaaaatatgcacataatgattttctttttattggaagtcatagtgtagtaatcaagaacttgctgtgaatttattttcaggattggtggatctggtatggacatgagaagtaaagctagagtgagtttttt

SEQ ID NO: 1297 - DNA, 200 bp, Kochia scoparia
aaaaaactcactctagctttacttctcatgtccataccagatccaccaatcctgaaaataaattcacagcaagttcttgattactacactatgacttccaataaaaagaaaatcattatgtgcatattttgttcaatgaaaaataagataaatatattttgctagtcaaataagcaatattgtaacactggaaaatatcc

SEQ ID NO: 1298 - DNA, 200 bp, Kochia scoparia
gaagtaaagctagagtgagtttttttttttcttttttttttgttattgatatttttaaccttaaaccttcacctaccaaaatgaatgaataaataaataaataaataaatttttgtttatattacgaagtacatttaaaaaaaacagagatgatgagtttatgatggttggtttattgtgtagacattggaggggcctgt

SEQ ID NO: 1299 - DNA, 200 bp, Kochia scoparia
acaggcccctccaatgtctacacaataaaccaaccatcataaactcatcatctctgttttttttaaatgtacttcgtaatataaacaaaaatttatttatttatttatttattcattcattttggtaggtgaaggtttaaggttaaaaatatcaataacaaaaaaaaaagaaaaaaaaaaactcactctagctttacttc

SEQ ID NO: 1300 - DNA, 200 bp, Kochia scoparia
ttgtgtagacattggaggggcctgtttctgatccgaaaaagcttccaaaatggaattatgatggatccagcactggtcaagctcctggtgaagacagtgaagttattctctagtatgtttttctgttctctttacttttgtaatcatttgatggtttaaatgagtctcttggttggtattggaaatcgatgtctacccac

SEQ ID NO: 1301 - DNA, 200 bp, Kochia scoparia
gtgggtagacatcgatttccaataccaaccaagagactcatttaaaccatcaaatgattacaaaagtaaagagaacagaaaaacatactagagaataacttcactgtcttcaccaggagcttgaccagtgctggatccatcataattccattttggaagctttttcggatcagaaacaggcccctccaatgtctacacaa

SEQ ID NO: 1302 - DNA, 200 bp, Kochia scoparia
gtattggaaatcgatgtctacccactcggtaaatgacccaccacagatggatagatagattgatagacagacgggaattattatagtttagtcgaaactacaagaagaatctctcaaagccattaggtattagtcattgtctaaagatatttggacctactcatgtatagtaattactggtacaaacttcaatccgatga

SEQ ID NO: 1303 - DNA, 200 bp, Kochia scoparia
tcatcggattgaagtttgtaccagtaattactatacatgagtaggtccaaatatctttagacaatgactaatacctaatggctttgagagattcttcttgtagtttcgactaaactataataattcccgtctgtctatcaatctatctatccatctgtggtgggtcatttaccgagtgggtagacatcgatttccaatac

SEQ ID NO: 1304 - DNA, 200 bp, Kochia scoparia
actggtacaaacttcaatccgatgatcatatcataatttttgtggcccatgtattgatttttgttggttggaaggaatgttttctagcttctatttcgctttcgtatggtaacttattacttaaaataaaggacaagaaaatgatttttgattttggaaagtatcgagaaatgttttttgaaagctattttcttatgaat

SEQ ID NO: 1305 - DNA, 200 bp, Kochia scoparia
attcataagaaaatagctttcaaaaaacatttctcgatactttccaaaatcaaaaatcattttcttgtcctttattttaagtaataagttaccatacgaaagcgaaatagaagctagaaaacattccttccaaccaacaaaaatcaatacatgggccacaaaaattatgatatgatcatcggattgaagtttgtaccagt

SEQ ID NO: 1306 - DNA, 200 bp, Kochia scoparia
ttttgaaagctattttcttatgaatatactaaaaatgtgatctaatctttattaaataatgccatacttgtccactgaaaatatatttatttgggggtcaactgttaattaattcttgatcatggttgtaacagcccacaagctatcttcagagatccattcaggaggggaaacaatatccttgtgagtttcgttgttac

SEQ ID NO: 1307 - DNA, 200 bp, Kochia scoparia
gtaacaacgaaactcacaaggatattgtttcccctcctgaatggatctctgaagatagcttgtgggctgttacaaccatgatcaagaattaattaacagttgacccccaaataaatatattttcagtggacaagtatggcattatttaataaagattagatcacatttttagtatattcataagaaaatagctttcaaaa

SEQ ID NO: 1308 - DNA, 200 bp, Kochia scoparia
atatccttgtgagtttcgttgttacctattttgttcgtgacatctgttagcatcattggctgttagtaggctaattcagtaatgctgatgatcacaactcacaagtaataatttggtgctgatttcaggttatgtgtgatgcctacaccccacaaggagagccgatcccaactaacaatagatgcaatgccgaaaagata

SEQ ID NO: 1309 - DNA, 200 bp, Kochia scoparia
tatcttttcggcattgcatctattgttagttgggatcggctctccttgtggggtgtaggcatcacacataacctgaaatcagcaccaaattattacttgtgagttgtgatcatcagcattactgaattagcctactaacagccaatgatgctaacagatgtcacgaacaaaataggtaacaacgaaactcacaaggatat

SEQ ID NO: 1310 - DNA, 200 bp, Kochia scoparia
caatagatgcaatgccgaaaagatattcagcaacccagaagttgccgctgaagtaccttggtaaaactttagtcaatgctggctggacaattgtttctagatttgatagttgtagtgaacttcagtattgtgaaatgtataggtatggtatcgagcaagaatatactttactgcagaaggatgtaaactggcccgttggc

SEQ ID NO: 1311 - DNA, 200 bp, Kochia scoparia
gccaacgggccagtttacatccttctgcagtaaagtatattcttgctcgataccatacctatacatttcacaatactgaagttcactacaactatcaaatctagaaacaattgtccagccagcattgactaaagttttaccaaggtacttcagcggcaacttctgggttgctgaatatcttttcggcattgcatctattg

SEQ ID NO: 1312 - DNA, 200 bp, Kochia scoparia
gaaggatgtaaactggcccgttggctggcctttaggcggctttcctggtccacaggtgaattatttgagctattatctaatttgactgctgttttgcaatttctttgcattaaactttgcaactgtaaaatttcacctgtaagaaattacttaaatactgttgcgtacttgttatatttgtgcctgtcattatgtgatgt

SEQ ID NO: 1313 - DNA, 200 bp, Kochia scoparia
acatcacataatgacaggcacaaatataacaagtacgcaacagtatttaagtaatttcttacaggtgaaattttacagttgcaaagtttaatgcaaagaaattgcaaaacagcagtcaaattagataatagctcaaataattcacctgtggaccaggaaagccgcctaaaggccagccaacgggccagtttacatccttc

SEQ ID NO: 1314 - DNA, 200 bp, Kochia scoparia
atttgtgcctgtcattatgtgatgtttaagaatgttttccactcataattttcctagtatttgagtaaagaagcttaagataatgatcagaccacaaaagagaatattgaaagaaacaggggaagtatgtgtttttgaaaaatatggacaggacacaaccaattaacagtcgttaaaaaaaaaataaaaatccgtgggtt

SEQ ID NO: 1315 - DNA, 200 bp, Kochia scoparia
aacccacggatttttattttttttttaacgactgttaattggttgtgtcctgtccatatttttcaaaaacacatacttcccctgtttctttcaatattctcttttgtggtctgatcattatcttaagcttctttactcaaatactaggaaaattatgagtggaaaacattcttaaacatcacataatgacaggcacaaat

SEQ ID NO: 1316 - DNA, 200 bp, Kochia scoparia
aaaaaaaaataaaaatccgtgggttaaaagatttctgggactgctgactgtctagtcaaatggtttgcttggtaatttgattttattagaactttctatcgctcattaaggatttgtaacgaagtgacaattttaatgatacttacagggcccatactactgtggtgttggtgctgataaagctttcggaagggacatcg

SEQ ID NO: 1317 - DNA, 200 bp, Kochia scoparia
cgatgtcccttccgaaagctttatcagcaccaacaccacagtagtatgggccctgtaagtatcattaaaattgtcacttcgttacaaatccttaatgagcgatagaaagttctaataaaatcaaattaccaagcaaaccatttgactagacagtcagcagtcccagaaatcttttaacccacggatttttattttttttt

SEQ ID NO: 1318 - DNA, 200 bp, Kochia scoparia
gataaagctttcggaagggacatcgttgattcccactacaaagcctgcctttatgctggaattaacatcagtggaattaacggtgaagtgatgccaggacaggtgaattggaaatacctttctattactacaaaaaattgttatattagttcgagtattgtaatgcattctatgtggctaatgttttcttccttttcgtt

SEQ ID NO: 1319 - DNA, 200 bp, Kochia scoparia
aacgaaaaggaagaaaacattagccacatagaatgcattacaatactcgaactaatataacaattttttgtagtaatagaaaggtatttccaattcacctgtcctggcatcacttcaccgttaattccactgatgttaattccagcataaaggcaggctttgtagtgggaatcaacgatgtcccttccgaaagctttatc

SEQ ID NO: 1320 - DNA, 200 bp, Kochia scoparia
ggctaatgttttcttccttttcgttccttagtgggaatttcaagttggtccatctgttggaatttctgctggtgatgaattgtgggtagctcgttacatattggaggtactttaaaaaaagttgtcgatttttatcttttcagacgaattaaatcttacaaatgattttgaatgtcaatatgaaactgtgcattggtttt

SEQ ID NO: 1321 - DNA, 200 bp, Kochia scoparia
aaaaccaatgcacagtttcatattgacattcaaaatcatttgtaagatttaattcgtctgaaaagataaaaatcgacaactttttttaaagtacctccaatatgtaacgagctacccacaattcatcaccagcagaaattccaacagatggaccaacttgaaattcccactaaggaacgaaaaggaagaaaacattagcc

SEQ ID NO: 1322 - DNA, 200 bp, Kochia scoparia
caatatgaaactgtgcattggtttttctgtttacagaggattactgaggttgctggagttgctctttcatttgatccaaaacccattccaggtgattggaatggtgctggtgctcacacaaactacaggtgtttgatttctaaacactttatcttagtcttatgagctctttgtatacaataatgatttattaatagatc

SEQ ID NO: 1323 - DNA, 200 bp, Kochia scoparia
gatctattaataaatcattattgtatacaaagagctcataagactaagataaagtgtttagaaatcaaacacctgtagtttgtgtgagcaccagcaccattccaatcacctggaatgggttttggatcaaatgaaagagcaactccagcaacctcagtaatcctctgtaaacagaaaaaccaatgcacagtttcatattg

SEQ ID NO: 1324 - DNA, 200 bp, Kochia scoparia
tacaataatgatttattaatagatcatgatcactaatgcttgttaatgtttatagcacaaaatctatgagggaagatggtggttacgaggtcattaagaaagctatcgaaaagcttgggttgaaacacgcggaacacatctctgcttatggtgagggaaatgaacgccgcctaactggtaaacatgaaacagccagcatt

SEQ ID NO: 1325 - DNA, 200 bp, Kochia scoparia
aatgctggctgtttcatgtttaccagttaggcggcgttcatttccctcaccataagcagagatgtgttccgcgtgtttcaacccaagcttttcgatagctttcttaatgacctcgtaaccaccatcttccctcatagattttgtgctataaacattaacaagcattagtgatcatgatctattaataaatcattattgta

SEQ ID NO: 1326 - DNA, 200 bp, Kochia scoparia
tggtaaacatgaaacagccagcatttcaactttcctgtgggtgagtattttctgaatatattctctccaatttgtaaccatcaaacttcacttgatctgcagtggtgccttttgatttttgaagtacttttcttttgtttcaaagttgcaaaattaccttttgcacatgattcctttcatctcagcttaacgtttgtgtc

SEQ ID NO: 1327 - DNA, 200 bp, Kochia scoparia
gacacaaacgttaagctgagatgaaaggaatcatgtgcaaaaggtaattttgcaactttgaaacaaaagaaaagtacttcaaaaatcaaaaggcaccactgcagatcaagtgaagtttgatggttacaaattggagagaatatattcagaaaatactcacccacaggaaagttgaaatgctggctgtttcatgtttacca

SEQ ID NO: 1328 - DNA, 200 bp, Lolium multiflorum
atgaccagaatatggtcaataaagcaattggttggttaaccctttagctgcatgcactatgaacttgtgatttgttcgaaacttcagttttaattcatttcctgaaaaccgtcagaccatttttcttcaaaatatgatgaaaccaaatcctataactggccagccctttggtcaaatcatatttcccatctgtaaagcct

SEQ ID NO: 1329 - DNA, 200 bp, Lolium multiflorum
aggctttacagatgggaaatatgatttgaccaaagggctggccagttataggatttggtttcatcatattttgaagaaaaatggtctgacggttttcaggaaatgaattaaaactgaagtttcgaacaaatcacaagttcatagtgcatgcagctaaagggttaaccaaccaattgctttattgaccatattctggtcat

SEQ ID NO: 1330 - DNA, 200 bp, Lolium multiflorum
atcatatttcccatctgtaaagccttctaattatcatcgtactgaccttaatcagagaatcacggagcaagctggtgtagtgctcactctggacccaaaaccaatccaggtatatccctgtaagttgttggaagcactttatatattgaaacttagtaaactgaagattaatttgatatagggtgactggaatggagctg

SEQ ID NO: 1331 - DNA, 200 bp, Lolium multiflorum
cagctccattccagtcaccctatatcaaattaatcttcagtttactaagtttcaatatataaagtgcttccaacaacttacagggatatacctggattggttttgggtccagagtgagcactacaccagcttgctccgtgattctctgattaaggtcagtacgatgataattagaaggctttacagatgggaaatatgat

SEQ ID NO: 1332 - DNA, 200 bp, Lolium multiflorum
atatagggtgactggaatggagctggctgccacacaaattacaggttccaatctcttctgttaaataatgcatttttcctgcttaacatttacagaatatcttattgtatattaacaatacatcagaaaacctaatatagctttgctttagtaaatgctgtggggttcacatcagaaggaaatgtatgctgggactaata

SEQ ID NO: 1333 - DNA, 200 bp, Lolium multiflorum
tattagtcccagcatacatttccttctgatgtgaaccccacagcatttactaaagcaaagctatattaggttttctgatgtattgttaatatacaataagatattctgtaaatgttaagcaggaaaaatgcattatttaacagaagagattggaacctgtaatttgtgtggcagccagctccattccagtcaccctatat

SEQ ID NO: 1334 - DNA, 200 bp, Lolium multiflorum
aaggaaatgtatgctgggactaatagaaaaaacccctccaaatacaaatttaaactggctataaatgggaaaccattattagtcgtcggttttttattgagcatgattcagaataagcatttattcacattagttaatcgctaaatttggttagttgtttttctcaatactcgatacagtttgtccttaatgtgcaagtg

SEQ ID NO: 1335 - DNA, 200 bp, Lolium multiflorum
cacttgcacattaaggacaaactgtatcgagtattgagaaaaacaactaaccaaatttagcgattaactaatgtgaataaatgcttattctgaatcatgctcaataaaaaaccgacgactaataatggtttcccatttatagccagtttaaatttgtatttggaggggttttttctattagtcccagcatacatttcctt

SEQ ID NO: 1336 - DNA, 200 bp, Lolium multiflorum
acagtttgtccttaatgtgcaagtgagaaactatcttttcttgttgttgcaaatatagcacaaagagcatgcgtgaagatggaggttttgcagtgattaagaaagcaatcctgaacctttcacttcgtcacgacttgcacatcagtgaatatggtgaaggaaatgaacggagattgacagggttacatgagacagctagc

SEQ ID NO: 1337 - DNA, 200 bp, Lolium multiflorum
gctagctgtctcatgtaaccctgtcaatctccgttcatttccttcaccatattcactgatgtgcaagtcgtgacgaagtgaaaggttcaggattgctttcttaatcactgcaaaacctccatcttcacgcatgctctttgtgctatatttgcaacaacaagaaaagatagtttctcacttgcacattaaggacaaactgt

SEQ ID NO: 1338 - DNA, 200 bp, Lolium multiflorum
caaacattagatgctctacgattaggtgttggagattataatcgggatacaggtatgtatgggatgatgtctaattatcatatggtgctgactatgaaagtatgaggaataatgctagatattttgcatcagatgaaaagtacaaatataaataatttccaacgtaagagctaagaaaaacattagaaattcagttcctg

SEQ ID NO: 1339 - DNA, 200 bp, Lolium multiflorum
caggaactgaatttctaatgtttttcttagctcttacgttggaaattatttatatttgtacttttcatctgatgcaaaatatctagcattattcctcatactttcatagtcagcaccatatgataattagacatcatcccatacatacctgtatcccgattataatctccaacacctaatcgtagagcatctaatgtttg

SEQ ID NO: 1340 - DNA, 200 bp, Lolium multiflorum
aaaaacattagaaattcagttcctggaaaagaaaagctactaccaggaaagtgatcagagcatttggcacctttgtatccactttcctgccttatctgttttatgatagcactagcacacacagtaggcttatctctgaatccaaaaacaggtacggtatcgagcaggagtacaccctccttcagaaggacgtgaactgg

SEQ ID NO: 1341 - DNA, 200 bp, Lolium multiflorum
ccagttcacgtccttctgaaggagggtgtactcctgctcgataccgtacctgtttttggattcagagataagcctactgtgtgtgctagtgctatcataaaacagataaggcaggaaagtggatacaaaggtgccaaatgctctgatcactttcctggtagtagcttttcttttccaggaactgaatttctaatgttttt

SEQ ID NO: 1342 - DNA, 200 bp, Lolium multiflorum
cctccttcagaaggacgtgaactggccccttggctggcccattggtggctaccctggtcctcagggcccctactactgcgccgccggtgcggacaaggcgttcggccgtgacatcgttgacgctcactacaaggcctgcctctacgccgggatcaacatcagcggcatcaacggggaggtcatgcccggccaggtactac

SEQ ID NO: 1343 - DNA, 200 bp, Lolium multiflorum
gtagtacctggccgggcatgacctccccgttgatgccgctgatgttgatcccggcgtagaggcaggccttgtagtgagcgtcaacgatgtcacggccgaacgccttgtccgcaccggcggcgcagtagtaggggccctgaggaccagggtagccaccaatgggccagccaaggggccagttcacgtccttctgaaggagg

SEQ ID NO: 1344 - DNA, 200 bp, Lolium multiflorum
gaggtcatgcccggccaggtactacacatcctcttgcagcaacttggtttctgtcttgtcagaaacacttctaacggtgatatggctgatgcgtgtgccgccaactctgactgtgaacctgattcctgtgtgacagtgggagttccaagttggcccgtccgttgggatcgccgcctccgaccagctctgggtggcccgct

SEQ ID NO: 1345 - DNA, 200 bp, Lolium multiflorum
agcgggccacccagagctggtcggaggcggcgatcccaacggacgggccaacttggaactcccactgtcacacaggaatcaggttcacagtcagagttggcggcacacgcatcagccatatcaccgttagaagtgtttctgacaagacagaaaccaagttgctgcaagaggatgtgtagtacctggccgggcatgacctc

SEQ ID NO: 1346 - DNA, 200 bp, Lolium multiflorum
ccacttgcattattcatttctggttttgcttttatgcagctatactgaaagggtcaatagtggacacttttacctgtttgttacatgtgccaagtgccatgtgagttaaaatgatttttttttttgcctttcaggttatgtgtgacacgtacacaccacaaggggaacccatccctaccaacaaacgcgccagggctgca

SEQ ID NO: 1347 - DNA, 200 bp, Lolium multiflorum
tgcagccctggcgcgtttgttggtagggatgggttccccttgtggtgtgtacgtgtcacacataacctgaaaggcaaaaaaaaaaatcattttaactcacatggcacttggcacatgtaacaaacaggtaaaagtgtccactattgaccctttcagtatagctgcataaaagcaaaaccagaaatgaataatgcaagtgg

SEQ ID NO: 1348 - DNA, 200 bp, Lolium multiflorum
taccaacaaacgcgccagggctgcacaaattttcagtgacccaaaggtttcttcgcaagtgccatggtaattatgcgttgagcacctgtatgccgtgcaaaggcctgctgttcttttacctccctttattcgcctgcagactatagagttgaaaaatcttcttttctaggtttggaatcgaacaggagtacactttgatg

SEQ ID NO: 1349 - DNA, 200 bp, Lolium multiflorum
catcaaagtgtactcctgttcgattccaaacctagaaaagaagatttttcaactctatagtctgcaggcgaataaagggaggtaaaagaacagcaggcctttgcacggcatacaggtgctcaacgcataattaccatggcacttgcgaagaaacctttgggtcactgaaaatttgtgcagccctggcgcgtttgttggta

SEQ ID NO: 1350 - DNA, 200 bp, Lolium multiflorum
aatcgaacaggagtacactttgatgcagagagacgtgaactggcctcttggctggcctgttggagggtaccctggcccccaggtactgtaccaagaagcttcatttactattcaaaaaataaatcttaggctggctgaaatacactttttagttaaacactgttgagtagtaatattgtgctgaaatattgcagggtcca

SEQ ID NO: 1351 - DNA, 200 bp, Lolium multiflorum
tggaccctgcaatatttcagcacaatattactactcaacagtgtttaactaaaaagtgtatttcagccagcctaagatttattttttgaatagtaaatgaagcttcttggtacagtacctgggggccagggtaccctccaacaggccagccaagaggccagttcacgtctctctgcatcaaagtgtactcctgttcgatt

SEQ ID NO: 1352 - DNA, 200 bp, Lolium multiflorum
ttgtgctgaaatattgcagggtccatactactgcgccgtgggatcagacaagtcatttggccgtgacatatcggatgctcactacaaggcatgcctttacgctggaattgaaatcagtggaacaaacggggaggtcatgcctggtcaggtgagcctttgtgtttatacgtgcgcacgtatacttatcttgtgtgaacccg

SEQ ID NO: 1353 - DNA, 200 bp, Lolium multiflorum
cgggttcacacaagataagtatacgtgcgcacgtataaacacaaaggctcacctgaccaggcatgacctccccgtttgttccactgatttcaattccagcgtaaaggcatgccttgtagtgagcatccgatatgtcacggccaaatgacttgtctgatcccacggcgcagtagtatggaccctgcaatatttcagcacaa

SEQ ID NO: 1354 - DNA, 200 bp, Lolium multiflorum
ccagccttcctcccttaatcctgctcctcgccctcagtccccacgccatggcgctcctcaccgatctcctcaacctcgacctctccggctccacggagaagatcatcgccgagtacatatggatcggcggatctggcatggatctcaggagcaaggccaggactctccccggcccggtctctgatcccagcaagctgccc

SEQ ID NO: 1355 - DNA, 200 bp, Lolium multiflorum
gggcagcttgctgggatcagagaccgggccggggagagtcctggccttgctcctgagatccatgccagatccgccgatccatatgtactcggcgatgatcttctccgtggagccggagaggtcgaggttgaggagatcggtgaggagcgccatggcgtggggactgagggcgaggagcaggattaagggaggaaggctgg

SEQ ID NO: 1356 - DNA, 200 bp, Lolium multiflorum
ggtctctgatcccagcaagctgcccaagtggaactacgacggctccagcaccggccaggcccccggcgaggacagcgaggtcatcctatacccacaggctatcttcaaggacccattcaggaggggaaacaacatccttgtcatgtgcgattgctacaccccagctggcgagcccatccccaccaacaagaggaacgcgg

SEQ ID NO: 1357 - DNA, 200 bp, Lolium multiflorum
ccgcgttcctcttgttggtggggatgggctcgccagctggggtgtagcaatcgcacatgacaaggatgttgtttcccctcctgaatgggtccttgaagatagcctgtgggtataggatgacctcgctgtcctcgccgggggcctggccggtgctggagccgtcgtagttccacttgggcagcttgctgggatcagagacc

SEQ ID NO: 1358 - DNA, 200 bp, Lolium multiflorum
atccccaccaacaagaggaacgcggctgctaagatcttcagcaaccctgctgttgctgccgaggagccatggtacggtattgagcaggagtacaccctcctgcagaaggatatcaactggcctcttggctggcccgttggtgggttcccggtcctcagggtccttactactgcagtatcggtgctgagaagtcctttggt

SEQ ID NO: 1359 - DNA, 200 bp, Lolium multiflorum
accaaaggacttctcagcaccgatactgcagtagtaaggaccctgaggaccgggaacccaccaacgggccagccaagaggccagttgatatccttctgcaggagggtgtactcctgctcaataccgtaccatggctcctcggcagcaacagcagggttgctgaagatcttagcagccgcgttcctcttgttggtggggat

SEQ ID NO: 1360 - DNA, 200 bp, Lolium multiflorum
tatcggtgctgagaagtcctttggtcgtgacatcgttgactcccactacaaggcttgcctcttcgccggcatcaacatcagtggcatcaatggcgaggtcatgcccggacagtgggagttccaagttggcccaagtgttggcatttctgctggtgaccaagtgtgggttgctcgctacattcttgagaggatcactgaga

SEQ ID NO: 1361 - DNA, 200 bp, Lolium multiflorum
tctcagtgatcctctcaagaatgtagcgagcaacccacacttggtcaccagcagaaatgccaacacttgggccaacttggaactcccactgtccgggcatgacctcgccattgatgccactgatgttgatgccggcgaagaggcaagccttgtagtgggagtcaacgatgtcacgaccaaaggacttctcagcaccgata

SEQ ID NO: 1362 - DNA, 200 bp, Lolium multiflorum
cccttggttcctgaaactacttgcactgtttggaaatgcaggaaagagttctacccagaaataaaattcaaggacattatgcaagcataattcttggggagtagaaagcccttaaactgtctaacctgggtcttaggttctttagctcattttacccatatggccatataacgaatatggatgccattctgatgattttg

SEQ ID NO: 1363 - DNA, 200 bp, Lolium multiflorum
caaaatcatcagaatggcatccatattcgttatatggccatatgggtaaaatgagctaaagaacctaagacccaggttagacagtttaagggctttctactccccaagaattatgcttgcataatgtccttgaattttatttctgggtagaactctttcctgcatttccaaacagtgcaagtagtttcaggaaccaaggg

SEQ ID NO: 1364 - DNA, 200 bp, Lolium multiflorum
tatggatgccattctgatgattttgaatagttctgggccaaatccacacccttgaattcgctattctgcaccctctacgtgttgagtgttatcaatttgaaaaatgttccttcactcatacatatctagtcaccaactgatggcctagctcacagttgaaagaaaaatacattggcaccaaattgatatcttactatact

SEQ ID NO: 1365 - DNA, 200 bp, Lolium multiflorum
agtatagtaagatatcaatttggtgccaatgtatttttctttcaactgtgagctaggccatcagttggtgactagatatgtatgagtgaaggaacatttttcaaattgataacactcaacacgtagagggtgcagaatagcgaattcaagggtgtggatttggcccagaactattcaaaatcatcagaatggcatccata

SEQ ID NO: 1366 - DNA, 200 bp, Lolium multiflorum
caccaaattgatatcttactatactattatcagtacccattcattatgacatggtaatttgcatggagccatacactgacagcgctgctgactgaaactaaaaggacttcatcttcatgccaacaggatacctggaggaccggcgtccggcctcaaacatggacccatacactgtgactgccctactggctgaaaccacg

SEQ ID NO: 1367 - DNA, 200 bp, Lolium multiflorum
cgtggtttcagccagtagggcagtcacagtgtatgggtccatgtttgaggccggacgccggtcctccaggtatcctgttggcatgaagatgaagtccttttagtttcagtcagcagcgctgtcagtgtatggctccatgcaaattaccatgtcataatgaatgggtactgataatagtatagtaagatatcaatttggtg

SEQ ID NO: 1368 - DNA, 200 bp, Lolium multiflorum
gactgccctactggctgaaaccacgattctctgggagccgacccttgaagcagaggctcttgctgccaagaagctggcgatgaacgtatgaaggactgaaaaggatgaatttctgggaaaaataaatcgacaacgacactgtttgtcgtccattcttcctgatcttgtggttccatcggggcactgtctgtacaaaattt

SEQ ID NO: 1369 - DNA, 200 bp, Lolium multiflorum
aaattttgtacagacagtgccccgatggaaccacaagatcaggaagaatggacgacaaacagtgtcgttgtcgatttatttttcccagaaattcatccttttcagtccttcatacgttcatcgccagcttcttggcagcaagagcctctgcttcaagggtcggctcccagagaatcgtggtttcagccagtagggcagtc

SEQ ID NO: 1370 - DNA, 200 bp, Lolium multiflorum
tcggggcactgtctgtacaaaatttacagtttgtagaaccactttgcctttcgcttgaacttcacatttgatctgggtctgtatctgattccacttggaactacgttaaaggataatgaaacacacaggattttgattctgctattttatttcctttgaatggttcaatctttaagactagtgtcatgggtggttcgtct

SEQ ID NO: 1371 - DNA, 200 bp, Lolium multiflorum
agacgaaccacccatgacactagtcttaaagattgaaccattcaaaggaaataaaatagcagaatcaaaatcctgtgtgtttcattatcctttaacgtagttccaagtggaatcagatacagacccagatcaaatgtgaagttcaagcgaaaggcaaagtggttctacaaactgtaaattttgtacagacagtgccccga

SEQ ID NO: 1372 - DNA, 200 bp, Lolium multiflorum
gactagtgtcatgggtggttcgtctgtctcgagaatttatctatagcgttaaagtttctcatgtttataaagctttgatggggaatgttggtgctattcctgcaattaaatggatgtgggatggttgttgtcaacagaggcacaaggttttcttttggccgcttgttcataattgcctcaacaccagggccctgctccaa

SEQ ID NO: 1373 - DNA, 200 bp, Lolium multiflorum
ttggagcagggccctggtgttgaggcaattatgaacaagcggccaaaagaaaaccttgtgcctctgttgacaacaaccatcccacatccatttaattgcaggaatagcaccaacattccccatcaaagctttataaacatgagaaactttaacgctatagataaattctcgagacagacgaaccacccatgacactagtc

SEQ ID NO: 1374 - DNA, 200 bp, Lolium multiflorum
cctcaacaccagggccctgctccaacgaaagaaaaacaccagggccctgctccaacgaaagaattttgtgatgaatgattattcttgtgtcatgtgtaatcagcagcatcttgagacaagagatcatctgttcttccaatgtccttttgttgtgctgtgctggcaatatctctgtcctctttgaatttccctcctttggg

SEQ ID NO: 1375 - DNA, 200 bp, Lolium multiflorum
cccaaaggagggaaattcaaagaggacagagatattgccagcacagcacaacaaaaggacattggaagaacagatgatctcttgtctcaagatgctgctgattacacatgacacaagaataatcattcatcacaaaattctttcgttggagcagggccctggtgtttttctttcgttggagcagggccctggtgttgagg

SEQ ID NO: 1376 - DNA, 200 bp, Lolium multiflorum
cctctttgaatttccctcctttggggtagtttgatcttcaagatacattatctggccttaagcttgctatctccaagcctttctttatggagctgataatgttgatcatatggtttatatggctcacccgcaatgattttatcttcaaggctgttcctccaatgattttatcttcaaagctgttcctccaagtgtttaca

SEQ ID NO: 1377 - DNA, 200 bp, Lolium multiflorum
tgtaaacacttggaggaacagctttgaagataaaatcattggaggaacagccttgaagataaaatcattgcgggtgagccatataaaccatatgatcaacattatcagctccataaagaaaggcttggagatagcaagcttaaggccagataatgtatcttgaagatcaaactaccccaaaggagggaaattcaaagagg

SEQ ID NO: 1378 - DNA, 200 bp, Lolium multiflorum
aaagctgttcctccaagtgtttacagatgtcggaagagatttaaggatgggcttgcccttctagttcacaaagcgaagagaaaatcttatcatggcatagtcacttgggtggaaattttagatagcctttgctttctctttgggcttatggcctcttttatttgctcctctcaagcaactgttctcttttgtagaccttt

SEQ ID NO: 1379 - DNA, 200 bp, Lolium multiflorum
aaaggtctacaaaagagaacagttgcttgagaggagcaaataaaagaggccataagcccaaagagaaagcaaaggctatctaaaatttccacccaagtgactatgccatgataagattttctcttcgctttgtgaactagaagggcaagcccatccttaaatctcttccgacatctgtaaacacttggaggaacagcttt

SEQ ID NO: 1380 - DNA, 200 bp, Lolium multiflorum
caactgttctcttttgtagaccttttaagcctttataaataaaataaaaaatatacagtggggaaactcactgtttagcctaaaaaaagaatttatctatagccataccaatataatgccatgatactaacacaagttaaaaatcagtggcgaagctagagattctgaccagtagggccagttatcttgtttatggtgta

SEQ ID NO: 1381 - DNA, 200 bp, Lolium multiflorum
tacaccataaacaagataactggccctactggtcagaatctctagcttcgccactgatttttaacttgtgttagtatcatggcattatattggtatggctatagataaattctttttttaggctaaacagtgagtttccccactgtatattttttattttatttataaaggcttaaaaggtctacaaaagagaacagttg

SEQ ID NO: 1382 - DNA, 200 bp, Lolium multiflorum
cgcgatcttgcagtcgccgaccgtttctcctcctctcccctcgtctgcgtctgctgccgcctctgctagcgttgacaagcaaggcggcagagtagctacctactagctagcctgatggcgcaggcggtggtgccggcgatgcagtgccagatgggcgcgctgggcaagtcggccgtccgtgccaggccggcggcggccgg

SEQ ID NO: 1383 - DNA, 200 bp, Lolium multiflorum
ccggccgccgccggcctggcacggacggccgacttgcccagcgcgcccatctggcactgcatcgccggcaccaccgcctgcgccatcaggctagctagtaggtagctactctgccgccttgcttgtcaacgctagcagaggcggcagcagacgcagacgaggggagaggaggagaaacggtcggcgactgcaagatcgcg

SEQ ID NO: 1384 - DNA, 200 bp, Lolium multiflorum
tccgtgccaggccggcggcggccgggggaagggtgtggggcgtcaggaggccgcccgcggcacggccgggttcaaggtgctggccctcggcccgagaccaccggggtcgtgcagaggatgaaccagctgctcgacatggacaccacgcccttcaccgacaagatcatcgcagagtacatctgggttggagggtctggaat

SEQ ID NO: 1385 - DNA, 200 bp, Lolium multiflorum
attccagaccctccaacccagatgtactctgcgatgatcttgtcggtgaagggcgtggtgtccatgtcgagcagctggttcatcctctgcacgaccccggtggtctcgggccgagggccagcaccttgaacccggccgtgccgcgggcggcctcctgacgccccacacccttcccccggccgccgccggcctggcacgga

SEQ ID NO: 1386 - DNA, 200 bp, Lolium multiflorum
acatctgggttggagggtctggaatcgacatcagaagcaaatcaaggacgatatcgaaaccggtggaggacccttccgagctaccgaagtggaactacgatggatcgagcacagggcaagctcctggagaagacagtgaagtcatcctatacccacaggctatattcaaggacccattccgaggaggcaacaacatcata

SEQ ID NO: 1387 - DNA, 200 bp, Lolium multiflorum
tatgatgttgttgcctcctcggaatgggtccttgaatatagcctgtgggtataggatgacttcactgtcttctccaggagcttgccctgtgctcgatccatcgtagttccacttcggtagctcggaagggtcctccaccggtttcgatatcgtccttgatttgcttctgatgtcgattccagaccctccaacccagatgt

SEQ ID NO: 1388 - DNA, 200 bp, Lolium multiflorum
attccgaggaggcaacaacatcatagttatgtgtgacacgtacacaccacaaggggaacccatccctaccaacaaacgcgccagggctgcacaaattttcagtgacccaaaggtttcttcgcaagtgccatggtttggaatcgaacaggagtacactttgatgcagagagacgtgaactggcctcttggctggcctgttg

SEQ ID NO: 1389 - DNA, 200 bp, Lolium multiflorum
caacaggccagccaagaggccagttcacgtctctctgcatcaaagtgtactcctgttcgattccaaaccatggcacttgcgaagaaacctttgggtcactgaaaatttgtgcagccctggcgcgtttgttggtagggatgggttccccttgtggtgtgtacgtgtcacacataactatgatgttgttgcctcctcggaat

SEQ ID NO: 1390 - DNA, 200 bp, Lolium multiflorum
aactggcctcttggctggcctgttggagggtaccctggcccccagggtccatactactgcgccgtgggatcagacaagtcatttggccgtgacatatcagatgctcactacaaggcatgcctttacgctggaattgaaatcagtggaacaaacggggaggtcatgcctggtcagtgggagtaccaggttggacctagtgt

SEQ ID NO: 1391 - DNA, 200 bp, Lolium multiflorum
acactaggtccaacctggtactcccactgaccaggcatgacctccccgtttgttccactgatttcaattccagcgtaaaggcatgccttgtagtgagcatctgatatgtcacggccaaatgacttgtctgatcccacggcgcagtagtatggaccctgggggccagggtaccctccaacaggccagccaagaggccagtt

SEQ ID NO: 1392 - DNA, 200 bp, Lolium multiflorum
gggagtaccaggttggacctagtgtgggtattgatgctggagatcacatatgggcttcaagatatcttctcgagagaatcacggagcaagctggtgtagtgctcactctggacccaaaaccaatccagggtgactggaatggagctggctgccacacaaattacagcacaaagagcatgcgtgaagatggaggttttgaa

SEQ ID NO: 1393 - DNA, 200 bp, Lolium multiflorum
ttcaaaacctccatcttcacgcatgctctttgtgctgtaatttgtgtggcagccagctccattccagtcaccctggattggttttgggtccagagtgagcactacaccagcttgctccgtgattctctcgagaagatatcttgaagcccatatgtgatctccagcatcaatacccacactaggtccaacctggtactccc

SEQ ID NO: 1394 - DNA, 200 bp, Lolium multiflorum
catgcgtgaagatggaggttttgaagtgattaagaaagcaatcctgaacctttcacttcgtcacgacttgcacatcagtgaatatggtgaaggaaatgaacggagattgacagggttacatgagacagctagcatatcagacttttcatggggtgtagcaaaccgtggttgttctattcgggtggggcgagacactgagg

SEQ ID NO: 1395 - DNA, 200 bp, Lolium multiflorum
cctcagtgtctcgccccacccgaatagaacaaccacggtttgctacaccccatgaaaagtctgatatgctagctgtctcatgtaaccctgtcaatctccgttcatttccttcaccatattcactgatgtgcaagtcgtgacgaagtgaaaggttcaggattgctttcttaatcacttcaaaacctccatcttcacgcatg

SEQ ID NO: 1396 - DNA, 200 bp, Lolium multiflorum
attcgggtggggcgagacactgaggcaaaagggaaaggatacctggaggaccggcgtccggcctcaaacatggacccatacactgtgactgccctactggctgaaaccacgattctctgggagccgacccttgaagcagaggctcttgctgccaagaagctggcgatgaacgtatgaaggactgaaaaggatgaatttct

SEQ ID NO: 1397 - DNA, 200 bp, Lolium multiflorum
agaaattcatccttttcagtccttcatacgttcatcgccagcttcttggcagcaagagcctctgcttcaagggtcggctcccagagaatcgtggtttcagccagtagggcagtcacagtgtatgggtccatgtttgaggccggacgccggtcctccaggtatcctttcccttttgcctcagtgtctcgccccacccgaat

SEQ ID NO: 1398 - DNA, 200 bp, Lolium multiflorum
gaaggactgaaaaggatgaatttctgggaaaaataaatcgacaacgacactgtttgtcgtccattcttcctgatcttgtggttccatcggggcactgtctgtacaaaatttacagtttgtagaaccactttgcctttcgcttgaacttcacatttgatctgggtctgtatctgattccacttggaactacgttaaaggat

SEQ ID NO: 1399 - DNA, 200 bp, Lolium multiflorum
atcctttaacgtagttccaagtggaatcagatacagacccagatcaaatgtgaagttcaagcgaaaggcaaagtggttctacaaactgtaaattttgtacagacagtgccccgatggaaccacaagatcaggaagaatggacgacaaacagtgtcgttgtcgatttatttttcccagaaattcatccttttcagtccttc

SEQ ID NO: 1400 - DNA, 200 bp, Lolium multiflorum
gtacacaccacaaggggaacccatccctaccaacaaacgcgccagggctgcacaaattttcagtgacccaaaggtttcttcgcaagtgccatggtaattatgcgttgagcacctgtatgccgtgcaaaggcctgctgttcttttacctccctttatttgcctacagactgtagagttgaaaaaacttcttttctaggttt

SEQ ID NO: 1401 - DNA, 200 bp, Lolium multiflorum
aaacctagaaaagaagttttttcaactctacagtctgtaggcaaataaagggaggtaaaagaacagcaggcctttgcacggcatacaggtgctcaacgcataattaccatggcacttgcgaagaaacctttgggtcactgaaaatttgtgcagccctggcgcgtttgttggtagggatgggttccccttgtggtgtgtac

SEQ ID NO: 1402 - DNA, 200 bp, Lolium multiflorum
ttgaaaaaacttcttttctaggtttggaatcgaacaggagtacactttgatgcagagagacgtgaactggcctcttggctggcctgttagagggtaccctggcccccaggtactgtaccaagaagattgatttactatacaaaaataaagcttaggctggctgaaatacactttattagttaaacactgttgagtagtaa

SEQ ID NO: 1403 - DNA, 200 bp, Lolium multiflorum
ttactactcaacagtgtttaactaataaagtgtatttcagccagcctaagctttatttttgtatagtaaatcaatcttcttggtacagtacctgggggccagggtaccctctaacaggccagccaagaggccagttcacgtctctctgcatcaaagtgtactcctgttcgattccaaacctagaaaagaagttttttcaa

SEQ ID NO: 1404 - DNA, 200 bp, Lolium multiflorum
ttagttaaacactgttgagtagtaatattgtgctgaaatattgcagggtccatactactgcgccgtgggatcagacaagtcatttggccgtgacatatcagatgctcactacaaggcatgcctttacgctggaattgaaatcagtggaacaaacggggaggtcatgcctggtcaggtgagcctttgtgtttatatgtgcg

SEQ ID NO: 1405 - DNA, 200 bp, Lolium multiflorum
cgcacatataaacacaaaggctcacctgaccaggcatgacctccccgtttgttccactgatttcaattccagcgtaaaggcatgccttgtagtgagcatctgatatgtcacggccaaatgacttgtctgatcccacggcgcagtagtatggaccctgcaatatttcagcacaatattactactcaacagtgtttaactaa

SEQ ID NO: 1406 - DNA, 200 bp, Lolium multiflorum
gtatttaacaattctgcctttctctcttcacatttcgcagggttggaggatctggaattgacataagaagcaaatcaagggtacgcagcccacaatcttcatggacttgacattatatatatttttttaaatgatttcttttctagaagtttaggggatgggaagttggttttgtacgcagagtactacttccttactac

SEQ ID NO: 1407 - DNA, 200 bp, Lolium multiflorum
gtagtaaggaagtagtactctgcgtacaaaaccaacttcccatcccctaaacttctagaaaagaaatcatttaaaaaaatatatataatgtcaagtccatgaagattgtgggctgcgtacccttgatttgcttcttatgtcaattccagatcctccaaccctgcgaaatgtgaagagagaaaggcagaattgttaaatac

SEQ ID NO: 1408 - DNA, 200 bp, Lolium multiflorum
acgcagagtactacttccttactaccttttcggctcctgacaagaaaatttaatgcctgcatttcagacgatatcgaaaccggtggaggacccttccgagctacccaagtggaactacgatggatcgagcacagggcaggctcctggagaagacagtgaagtcatcctatagtaagggggaaattgcagtatatgtgttc

SEQ ID NO: 1409 - DNA, 200 bp, Lolium multiflorum
gaacacatatactgcaatttcccccttactataggatgacttcactgtcttctccaggagcctgccctgtgctcgatccatcgtagttccacttgggtagctcggaagggtcctccaccggtttcgatatcgtctgaaatgcaggcattaaattttcttgtcaggagccgaaaaggtagtaaggaagtagtactctgcgt

SEQ ID NO: 1410 - DNA, 200 bp, Lolium multiflorum
tgaaattattgcaaacagatgacgctcctaaaaccggtaatctgggcctccaattattggtgcgcctggtcagagccttccaagttccaaaactatgaatggaaaacaataacaatggccatgccggtcaatcactgtacatataaacaacccaggccgttgaggtttggctgttgctcgtgtttattttgattggagag

SEQ ID NO: 1411 - DNA, 200 bp, Lolium multiflorum
ctctccaatcaaaataaacacgagcaacagccaaacctcaacggcctgggttgtttatatgtacagtgattgaccggcatggccattgttattgttttccattcatagttttggaacttggaaggctctgaccaggcgcaccaataattggaggcccagattaccggttttaggagcgtcatctgtttgcaataatttca

SEQ ID NO: 1412 - DNA, 200 bp, Lolium multiflorum
gctcgtgtttattttgattggagaggtcgcctgggcttggccggctcgcatgtggagacggacgtgacaaggagaggcagccgcatctttcatatccagagcacaaaaacacattgtaaactctatccaagatgtgtgtgcctgccttctgagcggcgcttccctttgctgtctttgcctccggtggtgctgcaagggcc

SEQ ID NO: 1413 - DNA, 200 bp, Lolium multiflorum
ggcccttgcagcaccaccggaggcaaagacagcaaagggaagcgccgctcagaaggcaggcacacacatcttggatagagtttacaatgtgtttttgtgctctggatatgaaagatgcggctgcctctccttgtcacgtccgtctccacatgcgagccggccaagcccaggcgacctctccaatcaaaataaacacgagc

SEQ ID NO: 1414 - DNA, 200 bp, Lolium multiflorum
tgcctccggtggtgctgcaagggccgccagaaatctcgtccacccaaagccctatcgcctaatcaagagccagatgccactgccccagccgcggccactagaatctctctcgcaaatctaaaatacttatacgcctcttgctctgcccccgtagatagataaataattccagcgcgatcttgcagtcgccgaccgtttct

SEQ ID NO: 1415 - DNA, 200 bp, Lolium multiflorum
agaaacggtcggcgactgcaagatcgcgctggaattatttatctatctacgggggcagagcaagaggcgtataagtattttagatttgcgagagagattctagtggccgcggctggggcagtggcatctggctcttgattaggcgatagggctttgggtggacgagatttctggcggcccttgcagcaccaccggaggca

SEQ ID NO: 1416 - DNA, 200 bp, Lolium multiflorum
gatcttgcagtcgccgaccgtttctcctcctctcccctcgtctgcccgtctgctgccgcctctggtgagtggtcgaaccaatgcctagtttcgttccttctctgttgcattcgctgctggctagtgatcgatccgatgtggtaatggcgcctatctgctttggttggttgatcagctagcgttgacaagcaaggcggcag

SEQ ID NO: 1417 - DNA, 200 bp, Lolium multiflorum
ctgccgccttgcttgtcaacgctagctgatcaaccaaccaaagcagataggcgccattaccacatcggatcgatcactagccagcagcgaatgcaacagagaaggaacgaaactaggcattggttcgaccactcaccagaggcggcagcagacgggcagacgaggggagaggaggagaaacggtcggcgactgcaagatc

SEQ ID NO: 1418 - DNA, 200 bp, Lolium multiflorum
ctagcgttgacaagcaaggcggcagagtagctacctactagctagcctgatggcgcaggcggtggtgccggcgatgcagtgccagatgggcgcgctgggcaagtcggccgtccgtgccagggccgggggaagggtgtggggcgtcaggagggccgcccgcggcacggccgggttcaaggtgctggccctcggcccggaga

SEQ ID NO: 1419 - DNA, 200 bp, Lolium multiflorum
tctccgggccgagggccagcaccttgaacccggccgtgccgcgggcggccctcctgacgccccacacccttcccccggccctggcacggacggccgacttgcccagcgcgcccatctggcactgcatcgccggcaccaccgcctgcgccatcaggctagctagtaggtagctactctgccgccttgcttgtcaacgctag

SEQ ID NO: 1420 - DNA, 200 bp, Lolium multiflorum
aaggtgctggccctcggcccggagaccaccggggtggtgcagaggatgaaccagctgctcgacatggacaccacgcccttcaccgacaagatcatcgcagagtacatctggtacgtacgtcctcccaatgttgcattcctcggttgcgccggagcgggctttgttcgcttccgttgactccccacgacagaacaccacca

SEQ ID NO: 1421 - DNA, 200 bp, Lolium multiflorum
tggtggtgttctgtcgtggggagtcaacggaagcgaacaaagcccgctccggcgcaaccgaggaatgcaacattgggaggacgtacgtaccagatgtactctgcgatgatcttgtcggtgaagggcgtggtgtccatgtcgagcagctggttcatcctctgcaccaccccggtggtctccgggccgagggccagcacctt

SEQ ID NO: 1422 - DNA, 200 bp, Lolium multiflorum
gactccccacgacagaacaccaccagtagcttcagataggccaaacccgcactttttgggactagattagtgccggggcaagcagattcgccccccttttaaggtttgatgatagtggttatttaattttctgtctaaagcttcctgggcatggtgggtgatgagtgacgaattcaaaagtgcttgctttttagttagtt

SEQ ID NO: 1423 - DNA, 200 bp, Lolium multiflorum
aactaactaaaaagcaagcacttttgaattcgtcactcatcacccaccatgcccaggaagctttagacagaaaattaaataaccactatcatcaaaccttaaaaggggggcgaatctgcttgccccggcactaatctagtcccaaaaagtgcgggtttggcctatctgaagctactggtggtgttctgtcgtggggagtc

SEQ ID NO: 1424 - DNA, 200 bp, Lolium multiflorum
aaaagtgcttgctttttagttagttccagcacttgaataagcttaggaaaatgcacatcgcactttgggggagcaataagggtcaaacaaattggtcctggcatctactaagtactagtacctctgtggcaaaatataagacgctttggtagcctatttttgggacacatgtaatattactagtattttaacaattctgc

SEQ ID NO: 1425 - DNA, 200 bp, Lolium multiflorum
gcagaattgttaaaatactagtaatattacatgtgtcccaaaaataggctaccaaagcgtcttatattttgccacagaggtactagtacttagtagatgccaggaccaatttgtttgacccttattgctcccccaaagtgcgatgtgcattttcctaagcttattcaagtgctggaactaactaaaaagcaagcactttt

SEQ ID NO: 1426 - DNA, 200 bp, Lolium multiflorum
attactagtattttaacaattctgcctttctctcttcacattccgcagggttggagggtctggaatcgacatcagaagcaaatcaagggtacgcagcccattatattcatgaaattgacattagatttgtttttttttttgaaaggatttttttctagaagtttagcggatgagaagttggttttgtatgcagagttctc

SEQ ID NO: 1427 - DNA, 200 bp, Lolium multiflorum
gagaactctgcatacaaaaccaacttctcatccgctaaacttctagaaaaaaatcctttcaaaaaaaaaaacaaatctaatgtcaatttcatgaatataatgggctgcgtacccttgatttgcttctgatgtcgattccagaccctccaaccctgcggaatgtgaagagagaaaggcagaattgttaaaatactagtaat

SEQ ID NO: 1428 - DNA, 200 bp, Sorghum halepense
ccacaagtgtggtacggccattattggaggattacacaagaagaagaaggtaggaggagatcacccaagcggacggacggcatggaatggaagtgggaagcgtcaaagtttttatgtgttttgttttggcacaccacgacctgacccaaattctagctaaattgcagtagtagagtagtataagcaaacggaacgggaag

SEQ ID NO: 1429 - DNA, 200 bp, Sorghum halepense
cttcccgttccgtttgcttatactactctactactgcaatttagctagaatttgggtcaggtcgtggtgtgccaaaacaaaacacataaaaactttgacgcttcccacttccattccatgccgtccgtccgcttgggtgatctcctcctaccttcttcttcttgtgtaatcctccaataatggccgtaccacacttgtgg

SEQ ID NO: 1430 - DNA, 200 bp, Sorghum halepense
tagtataagcaaacggaacgggaaggaacaattgttgcgcaaatcgctggacgggaccctgcaatgcaacggccggacactgccgcggaacaaaccgacacgacaaacggcgagctggatggaggaaaccttccgcttcagggcttccagaggatggtggtgtcggcgatcatggaggtcaccacgtatgggtccatgtt

SEQ ID NO: 1431 - DNA, 200 bp, Sorghum halepense
aacatggacccatacgtggtgacctccatgatcgccgacaccaccatcctctggaagccctgaagcggaaggtttcctccatccagctcgccgtttgtcgtgtcggtttgttccgcggcagtgtccggccgttgcattgcagggtcccgtccagcgatttgcgcaacaattgttccttcccgttccgtttgcttatacta

SEQ ID NO: 1432 - DNA, 200 bp, Sorghum halepense
aggtcaccacgtatgggtccatgttggacgccggccggcggtcctcgaagtagcccttgccgttctgctccgtctcccggcccacgcgcactgacgcgccacggtttgccactccccagctgaaggtgttgatgtcggcggtctcgtgcctgccggtgaggcggcgctcgttgccctcgccgtaggccgcgatgtgctcc

SEQ ID NO: 1433 - DNA, 200 bp, Sorghum halepense
ggagcacatcgcggcctacggcgagggcaacgagcgccgcctcaccggcaggcacgagaccgccgacatcaacaccttcagctggggagtggcaaaccgtggcgcgtcagtgcgcgtgggccgggagacggagcagaacggcaagggctacttcgaggaccgccggccggcgtccaacatggacccatacgtggtgacct

SEQ ID NO: 1434 - DNA, 200 bp, Sorghum halepense
ctcgccgtaggccgcgatgtgctccttgtgccgcagcttcagcttctcgatggcggccttgatcacctcgtacccgccctcgttcctcatggacttggtgctgtagttggtgtgtgcgccggcaccgttccagtcaccagggatgggctttgggtcgaatgtcaacaccacaccggcgatctcggtgatcctctcaagaa

SEQ ID NO: 1435 - DNA, 200 bp, Sorghum halepense
ttcttgagaggatcaccgagatcgccggtgtggtgttgacattcgacccaaagcccatccctggtgactggaacggtgccggcgcacacaccaactacagcaccaagtccatgaggaacgagggcgggtacgaggtgatcaaggccgccatcgagaagctgaagctgcggcacaaggagcacatcgcggcctacggcgag

SEQ ID NO: 1436 - DNA, 200 bp, Sorghum halepense
gcgatctcggtgatcctctcaagaatgtagcgagcaacccagacctgatcgcctgaagaaatgccgacggacggtccaacttggaattcccactgccctggcatgacctctccgttgatgccactgatgttgatgcctgcataaatgcaagccttgtagtgggcatcaactatatcacgcccgaatgacttgtccgcacc

SEQ ID NO: 1437 - DNA, 200 bp, Sorghum halepense
ggtgcggacaagtcattcgggcgtgatatagttgatgcccactacaaggcttgcatttatgcaggcatcaacatcagtggcatcaacggagaggtcatgccagggcagtgggaattccaagttggaccgtccgtcggcatttcttcaggcgatcaggtctgggttgctcgctacattcttgagaggatcaccgagatcgc

SEQ ID NO: 1438 - DNA, 200 bp, Sorghum halepense
cacgcccgaatgacttgtccgcaccaactccacagtagtacggaccctgagggccagggaagccaccaagaggccacccaaggggccagttggtgtccttctgaaggagggtgtactcctgctcaataccgtaccagggctcctcagcggcgacctcagggttgctgaagatcttggcggcgttgtgcctcttgttggtg

SEQ ID NO: 1439 - DNA, 200 bp, Sorghum halepense
caccaacaagaggcacaacgccgccaagatcttcagcaaccctgaggtcgccgctgaggagccctggtacggtattgagcaggagtacaccctccttcagaaggacaccaactggccccttgggtggcctcttggtggcttccctggccctcagggtccgtactactgtggagttggtgcggacaagtcattcgggcgtg

SEQ ID NO: 1440 - DNA, 200 bp, Sorghum halepense
ggcggcgttgtgcctcttgttggtgggaattggctcgccagctggggtgtagcaatcgcacatgacaaggatgttgttgcccctccggaatgggtccttgaagatagcctgcgggtacaggatgacctcactgtcctcgccgggggcctggccggtgctggagccgtcgtagttccacttgggcagcttgctgggatcgg

SEQ ID NO: 1441 - DNA, 200 bp, Sorghum halepense
ccgatcccagcaagctgcccaagtggaactacgacggctccagcaccggccaggcccccggcgaggacagtgaggtcatcctgtacccgcaggctatcttcaaggacccattccggaggggcaacaacatccttgtcatgtgcgattgctacaccccagctggcgagccaattcccaccaacaagaggcacaacgccgcc

SEQ ID NO: 1442 - DNA, 200 bp, Sorghum halepense
cacttgggcagcttgctgggatcggtcaccgggccggagagggtcctggctttgctcctgagatccatgccagatccaccgatccatatgtactcggcgatgatcttctcggtggtgtccgagaggctgaggttgacgaggtcggtgagggaggccatggccggcggcggctgggaaggacccaaaggaggaagaagagg

SEQ ID NO: 1443 - DNA, 200 bp, Sorghum halepense
cctcttcttcctcctttgggtccttcccagccgccgccggccatggcctccctcaccgacctcgtcaacctcagcctctcggacaccaccgagaagatcatcgccgagtacatatggatcggtggatctggcatggatctcaggagcaaagccaggaccctctccggcccggtgaccgatcccagcaagctgcccaagtg

SEQ ID NO: 1444 - DNA, 21 bp, Unknown
  Found in multiple species
ttgtcagtgtatggagtgaca

SEQ ID NO: 1445 - DNA, 21 bp, Unknown
  Found in multiple species
tgtcagtgtatggagtgacat

SEQ ID NO: 1446 - DNA, 21 bp, Unknown
  Found in multiple species
tgtcactccatacactgacaa

SEQ ID NO: 1447 - DNA, 21 bp, Unknown
  Found in multiple species
tggtcctcagggtccatacta

SEQ ID NO: 1448 - DNA, 21 bp, Unknown
  Found in multiple species
tggggaagttatgcctggcca

SEQ ID NO: 1449 - DNA, 21 bp, Unknown
  Found in multiple species
tggccaggcataacttcccca

SEQ ID NO: 1450 - DNA, 21 bp, Unknown
  Found in multiple species
tcttgtcagtgtatggagtga

SEQ ID NO: 1451 - DNA, 21 bp, Unknown
  Found in multiple species
tcactccatacactgacaaga

SEQ ID NO: 1452 - DNA, 21 bp, Unknown
  Found in multiple species
tagtatggaccctgaggacca

SEQ ID NO: 1453 - DNA, 21 bp, Unknown
  Found in multiple species
gtcagtgtatggagtgacatc

SEQ ID NO: 1454 - DNA, 21 bp, Unknown
  Found in multiple species
gtcactccatacactgacaag

SEQ ID NO: 1455 - DNA, 21 bp, Unknown
  Found in multiple species
gtatggaccctgaggaccagg

SEQ ID NO: 1456 - DNA, 21 bp, Unknown
  Found in multiple species
ggggaagttatgcctggccag

SEQ ID NO: 1457 - DNA, 21 bp, Unknown
  Found in multiple species
ggccaggcataacttccccat

SEQ ID NO: 1458 - DNA, 21 bp, Unknown
  Found in multiple species
gccaggcataacttccccatt

SEQ ID NO: 1459 - DNA, 21 bp, Unknown
  Found in multiple species
gatgtcactccatacactgac

SEQ ID NO: 1460 - DNA, 21 bp, Unknown
  Found in multiple species
cttgtcagtgtatggagtgac

SEQ ID NO: 1461 - DNA, 21 bp, Unknown
  Found in multiple species
ctggtcctcagggtccatact

SEQ ID NO: 1462 - DNA, 21 bp, Unknown
  Found in multiple species
ctggccaggcataacttcccc

SEQ ID NO: 1463 - DNA, 21 bp, Unknown
  Found in multiple species
cctggtcctcagggtccatac

SEQ ID NO: 1464 - DNA, 21 bp, Unknown
  Found in multiple species
cactccatacactgacaagat

SEQ ID NO: 1465 - DNA, 21 bp, Unknown
  Found in multiple species
atgtcactccatacactgaca

SEQ ID NO: 1466 - DNA, 21 bp, Unknown
  Found in multiple species
atggggaagttatgcctggcc

SEQ ID NO: 1467 - DNA, 21 bp, Unknown
  Found in multiple species
atcttgtcagtgtatggagtg

SEQ ID NO: 1468 - DNA, 21 bp, Unknown
  Found in multiple species
agtatggaccctgaggaccag

SEQ ID NO: 1469 - DNA, 21 bp, Unknown
  Found in multiple species
aatggggaagttatgcctggc

SEQ ID NO: 1470 - DNA, 21 bp, Unknown
  Found in multiple species
ttgcttgagggtataagatta

SEQ ID NO: 1471 - DNA, 21 bp, Unknown
  Found in multiple species
ttgagggtataagattacttc

SEQ ID NO: 1472 - DNA, 21 bp, Unknown
  Found in multiple species
tgcttgagggtataagattac

SEQ ID NO: 1473 - DNA, 21 bp, Unknown
  Found in multiple species
tgagggtataagattacttca

SEQ ID NO: 1474 - DNA, 21 bp, Unknown
  Found in multiple species
tgaagtaatcttataccctca

SEQ ID NO: 1475 - DNA, 21 bp, Unknown
  Found in multiple species
tcttataccctcaagcaattt

SEQ ID NO: 1476 - DNA, 21 bp, Unknown
  Found in multiple species
taatcttataccctcaagcaa

SEQ ID NO: 1477 - DNA, 21 bp, Unknown
  Found in multiple species
gtgaagtaatcttataccctc

SEQ ID NO: 1478 - DNA, 21 bp, Unknown
  Found in multiple species
gtaatcttataccctcaagca

SEQ ID NO: 1479 - DNA, 21 bp, Unknown
  Found in multiple species
gcttgagggtataagattact

SEQ ID NO: 1480 - DNA, 21 bp, Unknown
  Found in multiple species
gctggagatcatatctggtgt

SEQ ID NO: 1481 - DNA, 21 bp, Unknown
  Found in multiple species
gagggtataagattacttcac

SEQ ID NO: 1482 - DNA, 21 bp, Unknown
  Found in multiple species
gaagtaatcttataccctcaa

SEQ ID NO: 1483 - DNA, 21 bp, Unknown
  Found in multiple species
cttgagggtataagattactt

SEQ ID NO: 1484 - DNA, 21 bp, Unknown
  Found in multiple species
cttataccctcaagcaatttt

SEQ ID NO: 1485 - DNA, 21 bp, Unknown
  Found in multiple species
attgcttgagggtataagatt

SEQ ID NO: 1486 - DNA, 21 bp, Unknown
  Found in multiple species
atcttataccctcaagcaatt

SEQ ID NO: 1487 - DNA, 21 bp, Unknown
  Found in multiple species
agtgaagtaatcttataccct

SEQ ID NO: 1488 - DNA, 21 bp, Unknown
  Found in multiple species
agtaatcttataccctcaagc

SEQ ID NO: 1489 - DNA, 21 bp, Unknown
  Found in multiple species
agggtataagattacttcact

SEQ ID NO: 1490 - DNA, 21 bp, Unknown
  Found in multiple species
acaccagatatgatctccagc

SEQ ID NO: 1491 - DNA, 21 bp, Unknown
  Found in multiple species
aattgcttgagggtataagat

SEQ ID NO: 1492 - DNA, 21 bp, Unknown
  Found in multiple species
aatcttataccctcaagcaat

SEQ ID NO: 1493 - DNA, 21 bp, Unknown
  Found in multiple species
aagtaatcttataccctcaag

SEQ ID NO: 1494 - DNA, 21 bp, Unknown
  Found in multiple species
aaattgcttgagggtataaga

SEQ ID NO: 1495 - DNA, 21 bp, Unknown
  Found in multiple species
aaaattgcttgagggtataag

SEQ ID NO: 1496 - DNA, 21 bp, Unknown
  Found in multiple species
ttttggacgtgacatatctga

SEQ ID NO: 1497 - DNA, 21 bp, Unknown
  Found in multiple species
tttgtaatgagcatcagatat

SEQ ID NO: 1498 - DNA, 21 bp, Unknown
  Found in multiple species
tttggacgtgacatatctgat

SEQ ID NO: 1499 - DNA, 21 bp, Unknown
  Found in multiple species
tttccttctccatatgcactg

SEQ ID NO: 1500 - DNA, 21 bp, Unknown
  Found in multiple species
ttgtaatgagcatcagatatg

SEQ ID NO: 1501 - DNA, 21 bp, Unknown
  Found in multiple species
ttgtaatctgtgacacataca

SEQ ID NO: 1502 - DNA, 21 bp, Unknown
  Found in multiple species
ttggggtgttgccaatcgtgg

SEQ ID NO: 1503 - DNA, 21 bp, Unknown
  Found in multiple species
ttgggaagctcagatgggtgc

SEQ ID NO: 1504 - DNA, 21 bp, Unknown
  Found in multiple species
ttggacgtgacatatctgatg

SEQ ID NO: 1505 - DNA, 21 bp, Unknown
  Found in multiple species
ttggaattcccactggccagg

SEQ ID NO: 1506 - DNA, 21 bp, Unknown
  Found in multiple species
ttgcttcataaccaccatctt

SEQ ID NO: 1507 - DNA, 21 bp, Unknown
  Found in multiple species
ttgccttcttaattgcttcat

SEQ ID NO: 1508 - DNA, 21 bp, Unknown
  Found in multiple species
ttgccaatcgtggttgctcta

SEQ ID NO: 1509 - DNA, 21 bp, Unknown
  Found in multiple species
ttgagtagctgctccaccctg

SEQ ID NO: 1510 - DNA, 21 bp, Unknown
  Found in multiple species
ttgagccatcataattccact

SEQ ID NO: 1511 - DNA, 21 bp, Unknown
  Found in multiple species
ttgagcacccatctgagcttc

SEQ ID NO: 1512 - DNA, 21 bp, Unknown
  Found in multiple species
ttgaagctggagatcatatct

SEQ ID NO: 1513 - DNA, 21 bp, Unknown
  Found in multiple species
ttgaaaattgcttgagggtat

SEQ ID NO: 1514 - DNA, 21 bp, Unknown
  Found in multiple species
ttcttaattgcttcataacca

SEQ ID NO: 1515 - DNA, 21 bp, Unknown
  Found in multiple species
ttctcttggggtgttgccaat

SEQ ID NO: 1516 - DNA, 21 bp, Unknown
  Found in multiple species
ttctctcatggtctttgtact

SEQ ID NO: 1517 - DNA, 21 bp, Unknown
  Found in multiple species
ttctccatatgcactgatatg

SEQ ID NO: 1518 - DNA, 21 bp, Unknown
  Found in multiple species
ttcgttcatttccttctccat

SEQ ID NO: 1519 - DNA, 21 bp, Unknown
  Found in multiple species
ttccttctccatatgcactga

SEQ ID NO: 1520 - DNA, 21 bp, Unknown
  Found in multiple species
ttccgtggtggtaataatatc

SEQ ID NO: 1521 - DNA, 21 bp, Unknown
  Found in multiple species
ttccccatttgtgccactaat

SEQ ID NO: 1522 - DNA, 21 bp, Unknown
  Found in multiple species
ttcccactggccaggcataac

SEQ ID NO: 1523 - DNA, 21 bp, Unknown
  Found in multiple species
ttcccaagtggaattatgatg

SEQ ID NO: 1524 - DNA, 21 bp, Unknown
  Found in multiple species
ttcccaaagtattgtagtttc

SEQ ID NO: 1525 - DNA, 21 bp, Unknown
  Found in multiple species
ttccacttgggaagctcagat

SEQ ID NO: 1526 - DNA, 21 bp, Unknown
  Found in multiple species
ttccaatcaccctcaataggc

SEQ ID NO: 1527 - DNA, 21 bp, Unknown
  Found in multiple species
ttcatttccttctccatatgc

SEQ ID NO: 1528 - DNA, 21 bp, Unknown
  Found in multiple species
ttcataaccaccatcttctct

SEQ ID NO: 1529 - DNA, 21 bp, Unknown
  Found in multiple species
ttcaaaattgccttcttaatt

SEQ ID NO: 1530 - DNA, 21 bp, Unknown
  Found in multiple species
ttatgcctggccagtgggaat

SEQ ID NO: 1531 - DNA, 21 bp, Unknown
  Found in multiple species
ttatgaagcaattaagaaggc

SEQ ID NO: 1532 - DNA, 21 bp, Unknown
  Found in multiple species
ttataccctcaagcaattttc

SEQ ID NO: 1533 - DNA, 21 bp, Unknown
  Found in multiple species
ttagtggcacaaatggggaag

SEQ ID NO: 1534 - DNA, 21 bp, Unknown
  Found in multiple species
ttacaaggatattattaccac

SEQ ID NO: 1535 - DNA, 21 bp, Unknown
  Found in multiple species
ttaattgcttcataaccacca

SEQ ID NO: 1536 - DNA, 21 bp, Unknown
  Found in multiple species
ttaagaaggcaattttgaatc

SEQ ID NO: 1537 - DNA, 21 bp, Unknown
  Found in multiple species
tgttgccaatcgtggttgctc

SEQ ID NO: 1538 - DNA, 21 bp, Unknown
  Found in multiple species
tgttgagcacccatctgagct

SEQ ID NO: 1539 - DNA, 21 bp, Unknown
  Found in multiple species
tgtgtcacagattacaaggat

SEQ ID NO: 1540 - DNA, 21 bp, Unknown
  Found in multiple species
tgtcgatgctggcggtctcgt

SEQ ID NO: 1541 - DNA, 21 bp, Unknown
  Found in multiple species
tgtcacagattacaaggatat

SEQ ID NO: 1542 - DNA, 21 bp, Unknown
  Found in multiple species
tgtatgtgtcacagattacaa

SEQ ID NO: 1543 - DNA, 21 bp, Unknown
  Found in multiple species
tgtaatgagcatcagatatgt

SEQ ID NO: 1544 - DNA, 21 bp, Unknown
  Found in multiple species
tgtaatctgtgacacatacac

SEQ ID NO: 1545 - DNA, 21 bp, Unknown
  Found in multiple species
tggttgctctatccgtgtggg

SEQ ID NO: 1546 - DNA, 21 bp, Unknown
  Found in multiple species
tggttatgaagcaattaagaa

SEQ ID NO: 1547 - DNA, 21 bp, Unknown
  Found in multiple species
tggtggttatgaagcaattaa

SEQ ID NO: 1548 - DNA, 21 bp, Unknown
  Found in multiple species
tggtggtaataatatccttgt

SEQ ID NO: 1549 - DNA, 21 bp, Unknown
  Found in multiple species
tggtaataatatccttgtaat

SEQ ID NO: 1550 - DNA, 21 bp, Unknown
  Found in multiple species
tgggtgctcaacaggtttaga

SEQ ID NO: 1551 - DNA, 21 bp, Unknown
  Found in multiple species
tggggtgttgccaatcgtggt

SEQ ID NO: 1552 - DNA, 21 bp, Unknown
  Found in multiple species
tgggaagctcagatgggtgct

SEQ ID NO: 1553 - DNA, 21 bp, Unknown
  Found in multiple species
tggcggtctcgtgcttccctg

SEQ ID NO: 1554 - DNA, 21 bp, Unknown
  Found in multiple species
tggccagtgggaattccaagt

SEQ ID NO: 1555 - DNA, 21 bp, Unknown
  Found in multiple species
tggcacaaatggggaagttat

SEQ ID NO: 1556 - DNA, 21 bp, Unknown
  Found in multiple species
tggagatcatatctggtgtgc

SEQ ID NO: 1557 - DNA, 21 bp, Unknown
  Found in multiple species
tggagaaggaaatgaacgaag

SEQ ID NO: 1558 - DNA, 21 bp, Unknown
  Found in multiple species
tggacgtgacatatctgatgc

SEQ ID NO: 1559 - DNA, 21 bp, Unknown
  Found in multiple species
tggaccctgaggaccaggata

SEQ ID NO: 1560 - DNA, 21 bp, Unknown
  Found in multiple species
tggaattcccactggccaggc

SEQ ID NO: 1561 - DNA, 21 bp, Unknown
  Found in multiple species
tgcttcataaccaccatcttc

SEQ ID NO: 1562 - DNA, 21 bp, Unknown
  Found in multiple species
tgctggcggtctcgtgcttcc

SEQ ID NO: 1563 - DNA, 21 bp, Unknown
  Found in multiple species
tgccttcttaattgcttcata

SEQ ID NO: 1564 - DNA, 21 bp, Unknown
  Found in multiple species
tgcctggccagtgggaattcc

SEQ ID NO: 1565 - DNA, 21 bp, Unknown
  Found in multiple species
tgccaatcgtggttgctctat

SEQ ID NO: 1566 - DNA, 21 bp, Unknown
  Found in multiple species
tgcatatggagaaggaaatga

SEQ ID NO: 1567 - DNA, 21 bp, Unknown
  Found in multiple species
tgcactgatatggtccttgtg

SEQ ID NO: 1568 - DNA, 21 bp, Unknown
  Found in multiple species
tgatgctcattacaaagcttg

SEQ ID NO: 1569 - DNA, 21 bp, Unknown
  Found in multiple species
tgagtagctgctccaccctgt

SEQ ID NO: 1570 - DNA, 21 bp, Unknown
  Found in multiple species
tgagcttcccaagtggaatta

SEQ ID NO: 1571 - DNA, 21 bp, Unknown
  Found in multiple species
tgagccatcataattccactt

SEQ ID NO: 1572 - DNA, 21 bp, Unknown
  Found in multiple species
tgagcatcagatatgtcacgt

SEQ ID NO: 1573 - DNA, 21 bp, Unknown
  Found in multiple species
tgagcacccatctgagcttcc

SEQ ID NO: 1574 - DNA, 21 bp, Unknown
  Found in multiple species
tgagagaagatggtggttatg

SEQ ID NO: 1575 - DNA, 21 bp, Unknown
  Found in multiple species
tgacatatctgatgctcatta

SEQ ID NO: 1576 - DNA, 21 bp, Unknown
  Found in multiple species
tgacagggaagcacgagaccg

SEQ ID NO: 1577 - DNA, 21 bp, Unknown
  Found in multiple species
tgaagctggagatcatatctg

SEQ ID NO: 1578 - DNA, 21 bp, Unknown
  Found in multiple species
tgaagcaattaagaaggcaat

SEQ ID NO: 1579 - DNA, 21 bp, Unknown
  Found in multiple species
tgaacaagctggtgtggttct

SEQ ID NO: 1580 - DNA, 21 bp, Unknown
  Found in multiple species
tgaaaattgcttgagggtata

SEQ ID NO: 1581 - DNA, 21 bp, Unknown
  Found in multiple species
tcttttggacgtgacatatct

SEQ ID NO: 1582 - DNA, 21 bp, Unknown
  Found in multiple species
tcttggggtgttgccaatcgt

SEQ ID NO: 1583 - DNA, 21 bp, Unknown
  Found in multiple species
tcttctctcatggtctttgta

SEQ ID NO: 1584 - DNA, 21 bp, Unknown
  Found in multiple species
tcttaattgcttcataaccac

SEQ ID NO: 1585 - DNA, 21 bp, Unknown
  Found in multiple species
tctgatgctcattacaaagct

SEQ ID NO: 1586 - DNA, 21 bp, Unknown
  Found in multiple species
tctgagcttcccaagtggaat

SEQ ID NO: 1587 - DNA, 21 bp, Unknown
  Found in multiple species
tctcttggggtgttgccaatc

SEQ ID NO: 1588 - DNA, 21 bp, Unknown
  Found in multiple species
tctctcatggtctttgtactg

SEQ ID NO: 1589 - DNA, 21 bp, Unknown
  Found in multiple species
tctctaaacctgttgagcacc

SEQ ID NO: 1590 - DNA, 21 bp, Unknown
  Found in multiple species
tctccatatgcactgatatgg

SEQ ID NO: 1591 - DNA, 21 bp, Unknown
  Found in multiple species
tctcatggtctttgtactgta

SEQ ID NO: 1592 - DNA, 21 bp, Unknown
  Found in multiple species
tctaaacctgttgagcaccca

SEQ ID NO: 1593 - DNA, 21 bp, Unknown
  Found in multiple species
tcgttcatttccttctccata

SEQ ID NO: 1594 - DNA, 21 bp, Unknown
  Found in multiple species
tcgtggttgctctatccgtgt

SEQ ID NO: 1595 - DNA, 21 bp, Unknown
  Found in multiple species
tcgatgctggcggtctcgtgc

SEQ ID NO: 1596 - DNA, 21 bp, Unknown
  Found in multiple species
tccttgtaatctgtgacacat

SEQ ID NO: 1597 - DNA, 21 bp, Unknown
  Found in multiple species
tccttgaaaattgcttgaggg

SEQ ID NO: 1598 - DNA, 21 bp, Unknown
  Found in multiple species
tccttctccatatgcactgat

SEQ ID NO: 1599 - DNA, 21 bp, Unknown
  Found in multiple species
tcctggtcctcagggtccata

SEQ ID NO: 1600 - DNA, 21 bp, Unknown
  Found in multiple species
tcctccaatccaaatgtactc

SEQ ID NO: 1601 - DNA, 21 bp, Unknown
  Found in multiple species
tccgtggtggtaataatatcc

SEQ ID NO: 1602 - DNA, 21 bp, Unknown
  Found in multiple species
tccccatttgtgccactaatg

SEQ ID NO: 1603 - DNA, 21 bp, Unknown
  Found in multiple species
tcccactggccaggcataact

SEQ ID NO: 1604 - DNA, 21 bp, Unknown
  Found in multiple species
tcccaagtggaattatgatgg

SEQ ID NO: 1605 - DNA, 21 bp, Unknown
  Found in multiple species
tcccaaagtattgtagtttct

SEQ ID NO: 1606 - DNA, 21 bp, Unknown
  Found in multiple species
tccatatgcactgatatggtc

SEQ ID NO: 1607 - DNA, 21 bp, Unknown
  Found in multiple species
tccacttgggaagctcagatg

SEQ ID NO: 1608 - DNA, 21 bp, Unknown
  Found in multiple species
tccaatcaccctcaataggct

SEQ ID NO: 1609 - DNA, 21 bp, Unknown
  Found in multiple species
tccaaagcctattgagggtga

SEQ ID NO: 1610 - DNA, 21 bp, Unknown
  Found in multiple species
tcatttccttctccatatgca

SEQ ID NO: 1611 - DNA, 21 bp, Unknown
  Found in multiple species
tcataattccacttgggaagc

SEQ ID NO: 1612 - DNA, 21 bp, Unknown
  Found in multiple species
tcataaccaccatcttctctc

SEQ ID NO: 1613 - DNA, 21 bp, Unknown
  Found in multiple species
tcagtgcatatggagaaggaa

SEQ ID NO: 1614 - DNA, 21 bp, Unknown
  Found in multiple species
tcagatgggtgctcaacaggt

SEQ ID NO: 1615 - DNA, 21 bp, Unknown
  Found in multiple species
tcagatatgtcacgtccaaaa

SEQ ID NO: 1616 - DNA, 21 bp, Unknown
  Found in multiple species
tcaccctcaataggctttgga

SEQ ID NO: 1617 - DNA, 21 bp, Unknown
  Found in multiple species
tcacagattacaaggatatta

SEQ ID NO: 1618 - DNA, 21 bp, Unknown
  Found in multiple species
tcaagcaattttcaaggatcc

SEQ ID NO: 1619 - DNA, 21 bp, Unknown
  Found in multiple species
tcaaacatggacccatacgtg

SEQ ID NO: 1620 - DNA, 21 bp, Unknown
  Found in multiple species
tcaaaattgccttcttaattg

SEQ ID NO: 1621 - DNA, 21 bp, Unknown
  Found in multiple species
tatgtgtcacagattacaagg

SEQ ID NO: 1622 - DNA, 21 bp, Unknown
  Found in multiple species
tatggagaaggaaatgaacga

SEQ ID NO: 1623 - DNA, 21 bp, Unknown
  Found in multiple species
tatggaccctgaggaccagga

SEQ ID NO: 1624 - DNA, 21 bp, Unknown
  Found in multiple species
tatgcctggccagtgggaatt

SEQ ID NO: 1625 - DNA, 21 bp, Unknown
  Found in multiple species
tatgcactgatatggtccttg

SEQ ID NO: 1626 - DNA, 21 bp, Unknown
  Found in multiple species
tatgaagcaattaagaaggca

SEQ ID NO: 1627 - DNA, 21 bp, Unknown
  Found in multiple species
tatctgatgctcattacaaag

SEQ ID NO: 1628 - DNA, 21 bp, Unknown
  Found in multiple species
tatccttgtaatctgtgacac

SEQ ID NO: 1629 - DNA, 21 bp, Unknown
  Found in multiple species
tatcctggtcctcagggtcca

SEQ ID NO: 1630 - DNA, 21 bp, Unknown
  Found in multiple species
tatcagtgcatatggagaagg

SEQ ID NO: 1631 - DNA, 21 bp, Unknown
  Found in multiple species
tataccctcaagcaattttca

SEQ ID NO: 1632 - DNA, 21 bp, Unknown
  Found in multiple species
tagtggcacaaatggggaagt

SEQ ID NO: 1633 - DNA, 21 bp, Unknown
  Found in multiple species
tagagcaaccacgattggcaa

SEQ ID NO: 1634 - DNA, 21 bp, Unknown
  Found in multiple species
taccctcaagcaattttcaag

SEQ ID NO: 1635 - DNA, 21 bp, Unknown
  Found in multiple species
tacagtacaaagaccatgaga

SEQ ID NO: 1636 - DNA, 21 bp, Unknown
  Found in multiple species
tacaaggatattattaccacc

SEQ ID NO: 1637 - DNA, 21 bp, Unknown
  Found in multiple species
tacaaagaccatgagagaaga

SEQ ID NO: 1638 - DNA, 21 bp, Unknown
  Found in multiple species
taattgcttcataaccaccat

SEQ ID NO: 1639 - DNA, 21 bp, Unknown
  Found in multiple species
taattccacttgggaagctca

SEQ ID NO: 1640 - DNA, 21 bp, Unknown
  Found in multiple species
taatgagcatcagatatgtca

SEQ ID NO: 1641 - DNA, 21 bp, Unknown
  Found in multiple species
taatatccttgtaatctgtga

SEQ ID NO: 1642 - DNA, 21 bp, Unknown
  Found in multiple species
taataatatccttgtaatctg

SEQ ID NO: 1643 - DNA, 21 bp, Unknown
  Found in multiple species
taagaaggcaattttgaatct

SEQ ID NO: 1644 - DNA, 21 bp, Unknown
  Found in multiple species
taacttccccatttgtgccac

SEQ ID NO: 1645 - DNA, 21 bp, Unknown
  Found in multiple species
taaccaccatcttctctcatg

SEQ ID NO: 1646 - DNA, 21 bp, Unknown
  Found in multiple species
taaacctgttgagcacccatc

SEQ ID NO: 1647 - DNA, 21 bp, Unknown
  Found in multiple species
taaacagggtggagcagctac

SEQ ID NO: 1648 - DNA, 21 bp, Unknown
  Found in multiple species
gttgccaatcgtggttgctct

SEQ ID NO: 1649 - DNA, 21 bp, Unknown
  Found in multiple species
gttgagtagctgctccaccct

SEQ ID NO: 1650 - DNA, 21 bp, Unknown
  Found in multiple species
gttgagcacccatctgagctt

SEQ ID NO: 1651 - DNA, 21 bp, Unknown
  Found in multiple species
gttcccaaagtattgtagttt

SEQ ID NO: 1652 - DNA, 21 bp, Unknown
  Found in multiple species
gttcatttccttctccatatg

SEQ ID NO: 1653 - DNA, 21 bp, Unknown
  Found in multiple species
gttatgcctggccagtgggaa

SEQ ID NO: 1654 - DNA, 21 bp, Unknown
  Found in multiple species
gttatgaagcaattaagaagg

SEQ ID NO: 1655 - DNA, 21 bp, Unknown
  Found in multiple species
gtgttgccaatcgtggttgct

SEQ ID NO: 1656 - DNA, 21 bp, Unknown
  Found in multiple species
gtgtcgatgctggcggtctcg

SEQ ID NO: 1657 - DNA, 21 bp, Unknown
  Found in multiple species
gtgtcacagattacaaggata

SEQ ID NO: 1658 - DNA, 21 bp, Unknown
  Found in multiple species
gtgtatgtgtcacagattaca

SEQ ID NO: 1659 - DNA, 21 bp, Unknown
  Found in multiple species
gtggttgctctatccgtgtgg

SEQ ID NO: 1660 - DNA, 21 bp, Unknown
  Found in multiple species
gtggttatgaagcaattaaga

SEQ ID NO: 1661 - DNA, 21 bp, Unknown
  Found in multiple species
gtggtggtaataatatccttg

SEQ ID NO: 1662 - DNA, 21 bp, Unknown
  Found in multiple species
gtggtaataatatccttgtaa

SEQ ID NO: 1663 - DNA, 21 bp, Unknown
  Found in multiple species
gtggcacaaatggggaagtta

SEQ ID NO: 1664 - DNA, 21 bp, Unknown
  Found in multiple species
gtggaattatgatggctcaag

SEQ ID NO: 1665 - DNA, 21 bp, Unknown
  Found in multiple species
gtgctcaacaggtttagagat

SEQ ID NO: 1666 - DNA, 21 bp, Unknown
  Found in multiple species
gtgcatatggagaaggaaatg

SEQ ID NO: 1667 - DNA, 21 bp, Unknown
  Found in multiple species
gtgacatatctgatgctcatt

SEQ ID NO: 1668 - DNA, 21 bp, Unknown
  Found in multiple species
gtcgatgctggcggtctcgtg

SEQ ID NO: 1669 - DNA, 21 bp, Unknown
  Found in multiple species
gtcacagattacaaggatatt

SEQ ID NO: 1670 - DNA, 21 bp, Unknown
  Found in multiple species
gtatgtgtcacagattacaag

SEQ ID NO: 1671 - DNA, 21 bp, Unknown
  Found in multiple species
gtagctgctccaccctgttta

SEQ ID NO: 1672 - DNA, 21 bp, Unknown
  Found in multiple species
gtacatttggattggaggatc

SEQ ID NO: 1673 - DNA, 21 bp, Unknown
  Found in multiple species
gtacaaagaccatgagagaag

SEQ ID NO: 1674 - DNA, 21 bp, Unknown
  Found in multiple species
gtaatgagcatcagatatgtc

SEQ ID NO: 1675 - DNA, 21 bp, Unknown
  Found in multiple species
gtaataatatccttgtaatct

SEQ ID NO: 1676 - DNA, 21 bp, Unknown
  Found in multiple species
ggttcccaaagtattgtagtt

SEQ ID NO: 1677 - DNA, 21 bp, Unknown
  Found in multiple species
ggttatgaagcaattaagaag

SEQ ID NO: 1678 - DNA, 21 bp, Unknown
  Found in multiple species
ggtgttgccaatcgtggttgc

SEQ ID NO: 1679 - DNA, 21 bp, Unknown
  Found in multiple species
ggtggttatgaagcaattaag

SEQ ID NO: 1680 - DNA, 21 bp, Unknown
  Found in multiple species
ggtggtaataatatccttgta

SEQ ID NO: 1681 - DNA, 21 bp, Unknown
  Found in multiple species
ggtggagcagctactcaactt

SEQ ID NO: 1682 - DNA, 21 bp, Unknown
  Found in multiple species
ggtgctcaacaggtttagaga

SEQ ID NO: 1683 - DNA, 21 bp, Unknown
  Found in multiple species
ggtaataatatccttgtaatc

SEQ ID NO: 1684 - DNA, 21 bp, Unknown
  Found in multiple species
gggtgttgccaatcgtggttg

SEQ ID NO: 1685 - DNA, 21 bp, Unknown
  Found in multiple species
gggtggagcagctactcaact

SEQ ID NO: 1686 - DNA, 21 bp, Unknown
  Found in multiple species
gggtgctcaacaggtttagag

SEQ ID NO: 1687 - DNA, 21 bp, Unknown
  Found in multiple species
ggggtgttgccaatcgtggtt

SEQ ID NO: 1688 - DNA, 21 bp, Unknown
  Found in multiple species
gggaagttatgcctggccagt

SEQ ID NO: 1689 - DNA, 21 bp, Unknown
  Found in multiple species
gggaagctcagatgggtgctc

SEQ ID NO: 1690 - DNA, 21 bp, Unknown
  Found in multiple species
gggaagcacgagaccgccagc

SEQ ID NO: 1691 - DNA, 21 bp, Unknown
  Found in multiple species
ggcggtctcgtgcttccctgt

SEQ ID NO: 1692 - DNA, 21 bp, Unknown
  Found in multiple species
ggccagtgggaattccaagtt

SEQ ID NO: 1693 - DNA, 21 bp, Unknown
  Found in multiple species
ggcataacttccccatttgtg

SEQ ID NO: 1694 - DNA, 21 bp, Unknown
  Found in multiple species
ggcacaaatggggaagttatg

SEQ ID NO: 1695 - DNA, 21 bp, Unknown
  Found in multiple species
ggatccttgaaaattgcttga

SEQ ID NO: 1696 - DNA, 21 bp, Unknown
  Found in multiple species
ggatattattaccaccacgga

SEQ ID NO: 1697 - DNA, 21 bp, Unknown
  Found in multiple species
ggatagagcaaccacgattgg

SEQ ID NO: 1698 - DNA, 21 bp, Unknown
  Found in multiple species
ggacgtgacatatctgatgct

SEQ ID NO: 1699 - DNA, 21 bp, Unknown
  Found in multiple species
ggaccatatcagtgcatatgg

SEQ ID NO: 1700 - DNA, 21 bp, Unknown
  Found in multiple species
ggaattcccactggccaggca

SEQ ID NO: 1701 - DNA, 21 bp, Unknown
  Found in multiple species
ggaagttatgcctggccagtg

SEQ ID NO: 1702 - DNA, 21 bp, Unknown
  Found in multiple species
ggaagctcagatgggtgctca

SEQ ID NO: 1703 - DNA, 21 bp, Unknown
  Found in multiple species
ggaagcacgagaccgccagca

SEQ ID NO: 1704 - DNA, 21 bp, Unknown
  Found in multiple species
gctttgtaatgagcatcagat

SEQ ID NO: 1705 - DNA, 21 bp, Unknown
  Found in multiple species
gcttcccaagtggaattatga

SEQ ID NO: 1706 - DNA, 21 bp, Unknown
  Found in multiple species
gcttcataaccaccatcttct

SEQ ID NO: 1707 - DNA, 21 bp, Unknown
  Found in multiple species
gctggcggtctcgtgcttccc

SEQ ID NO: 1708 - DNA, 21 bp, Unknown
  Found in multiple species
gctcagatgggtgctcaacag

SEQ ID NO: 1709 - DNA, 21 bp, Unknown
  Found in multiple species
gcggtctcgtgcttccctgtc

SEQ ID NO: 1710 - DNA, 21 bp, Unknown
  Found in multiple species
gccttcttaattgcttcataa

SEQ ID NO: 1711 - DNA, 21 bp, Unknown
  Found in multiple species
gcctggccagtgggaattcca

SEQ ID NO: 1712 - DNA, 21 bp, Unknown
  Found in multiple species
gcctattgagggtgattggaa

SEQ ID NO: 1713 - DNA, 21 bp, Unknown
  Found in multiple species
gccatcataattccacttggg

SEQ ID NO: 1714 - DNA, 21 bp, Unknown
  Found in multiple species
gccagtgggaattccaagttg

SEQ ID NO: 1715 - DNA, 21 bp, Unknown
  Found in multiple species
gccaatcgtggttgctctatc

SEQ ID NO: 1716 - DNA, 21 bp, Unknown
  Found in multiple species
gcatcagatatgtcacgtcca

SEQ ID NO: 1717 - DNA, 21 bp, Unknown
  Found in multiple species
gcatatggagaaggaaatgaa

SEQ ID NO: 1718 - DNA, 21 bp, Unknown
  Found in multiple species
gcataacttccccatttgtgc

SEQ ID NO: 1719 - DNA, 21 bp, Unknown
  Found in multiple species
gcagaaactacaatactttgg

SEQ ID NO: 1720 - DNA, 21 bp, Unknown
  Found in multiple species
gcacgagaccgccagcatcga

SEQ ID NO: 1721 - DNA, 21 bp, Unknown
  Found in multiple species
gcacccatctgagcttcccaa

SEQ ID NO: 1722 - DNA, 21 bp, Unknown
  Found in multiple species
gcacaccagatatgatctcca

SEQ ID NO: 1723 - DNA, 21 bp, Unknown
  Found in multiple species
gcacaaatggggaagttatgc

SEQ ID NO: 1724 - DNA, 21 bp, Unknown
  Found in multiple species
gcaattaagaaggcaattttg

SEQ ID NO: 1725 - DNA, 21 bp, Unknown
  Found in multiple species
gcaaccacgattggcaacacc

SEQ ID NO: 1726 - DNA, 21 bp, Unknown
  Found in multiple species
gattggcaacaccccaagaga

SEQ ID NO: 1727 - DNA, 21 bp, Unknown
  Found in multiple species
gattcaaaattgccttcttaa

SEQ ID NO: 1728 - DNA, 21 bp, Unknown
  Found in multiple species
gattacaaggatattattacc

SEQ ID NO: 1729 - DNA, 21 bp, Unknown
  Found in multiple species
gatggtggttatgaagcaatt

SEQ ID NO: 1730 - DNA, 21 bp, Unknown
  Found in multiple species
gatgggtgctcaacaggttta

SEQ ID NO: 1731 - DNA, 21 bp, Unknown
  Found in multiple species
gatgctggcggtctcgtgctt

SEQ ID NO: 1732 - DNA, 21 bp, Unknown
  Found in multiple species
gatccttgaaaattgcttgag

SEQ ID NO: 1733 - DNA, 21 bp, Unknown
  Found in multiple species
gatcctccaatccaaatgtac

SEQ ID NO: 1734 - DNA, 21 bp, Unknown
  Found in multiple species
gatccaaagcctattgagggt

SEQ ID NO: 1735 - DNA, 21 bp, Unknown
  Found in multiple species
gatattattaccaccacggaa

SEQ ID NO: 1736 - DNA, 21 bp, Unknown
  Found in multiple species
gatatgatctccagcttcaat

SEQ ID NO: 1737 - DNA, 21 bp, Unknown
  Found in multiple species
gatagagcaaccacgattggc

SEQ ID NO: 1738 - DNA, 21 bp, Unknown
  Found in multiple species
gagtagctgctccaccctgtt

SEQ ID NO: 1739 - DNA, 21 bp, Unknown
  Found in multiple species
gagtacatttggattggagga

SEQ ID NO: 1740 - DNA, 21 bp, Unknown
  Found in multiple species
gagcttcccaagtggaattat

SEQ ID NO: 1741 - DNA, 21 bp, Unknown
  Found in multiple species
gagccatcataattccacttg

SEQ ID NO: 1742 - DNA, 21 bp, Unknown
  Found in multiple species
gagcatcagatatgtcacgtc

SEQ ID NO: 1743 - DNA, 21 bp, Unknown
  Found in multiple species
gagcacccatctgagcttccc

SEQ ID NO: 1744 - DNA, 21 bp, Unknown
  Found in multiple species
gagcaaccacgattggcaaca

SEQ ID NO: 1745 - DNA, 21 bp, Unknown
  Found in multiple species
gagagaagatggtggttatga

SEQ ID NO: 1746 - DNA, 21 bp, Unknown
  Found in multiple species
gagaagatggtggttatgaag

SEQ ID NO: 1747 - DNA, 21 bp, Unknown
  Found in multiple species
gacgtgacatatctgatgctc

SEQ ID NO: 1748 - DNA, 21 bp, Unknown
  Found in multiple species
gaccatgagagaagatggtgg

SEQ ID NO: 1749 - DNA, 21 bp, Unknown
  Found in multiple species
gaccatatcagtgcatatgga

SEQ ID NO: 1750 - DNA, 21 bp, Unknown
  Found in multiple species
gacatatctgatgctcattac

SEQ ID NO: 1751 - DNA, 21 bp, Unknown
  Found in multiple species
gacagggaagcacgagaccgc

SEQ ID NO: 1752 - DNA, 21 bp, Unknown
  Found in multiple species
gaattcccactggccaggcat

SEQ ID NO: 1753 - DNA, 21 bp, Unknown
  Found in multiple species
gaagttatgcctggccagtgg

SEQ ID NO: 1754 - DNA, 21 bp, Unknown
  Found in multiple species
gaagctggagatcatatctgg

SEQ ID NO: 1755 - DNA, 21 bp, Unknown
  Found in multiple species
gaagctcagatgggtgctcaa

SEQ ID NO: 1756 - DNA, 21 bp, Unknown
  Found in multiple species
gaagcacgagaccgccagcat

SEQ ID NO: 1757 - DNA, 21 bp, Unknown
  Found in multiple species
gaagcaattaagaaggcaatt

SEQ ID NO: 1758 - DNA, 21 bp, Unknown
  Found in multiple species
gaagatggtggttatgaagca

SEQ ID NO: 1759 - DNA, 21 bp, Unknown
  Found in multiple species
gaaccacaccagcttgttcag

SEQ ID NO: 1760 - DNA, 21 bp, Unknown
  Found in multiple species
gaaactacaatactttgggaa

SEQ ID NO: 1761 - DNA, 21 bp, Unknown
  Found in multiple species
gaaaattgcttgagggtataa

SEQ ID NO: 1762 - DNA, 21 bp, Unknown
  Found in multiple species
cttttggacgtgacatatctg

SEQ ID NO: 1763 - DNA, 21 bp, Unknown
  Found in multiple species
ctttgtaatgagcatcagata

SEQ ID NO: 1764 - DNA, 21 bp, Unknown
  Found in multiple species
cttgtaatctgtgacacatac

SEQ ID NO: 1765 - DNA, 21 bp, Unknown
  Found in multiple species
cttggggtgttgccaatcgtg

SEQ ID NO: 1766 - DNA, 21 bp, Unknown
  Found in multiple species
cttgggaagctcagatgggtg

SEQ ID NO: 1767 - DNA, 21 bp, Unknown
  Found in multiple species
cttggaattcccactggccag

SEQ ID NO: 1768 - DNA, 21 bp, Unknown
  Found in multiple species
cttgagccatcataattccac

SEQ ID NO: 1769 - DNA, 21 bp, Unknown
  Found in multiple species
cttgaaaattgcttgagggta

SEQ ID NO: 1770 - DNA, 21 bp, Unknown
  Found in multiple species
cttcttaattgcttcataacc

SEQ ID NO: 1771 - DNA, 21 bp, Unknown
  Found in multiple species
cttctctcatggtctttgtac

SEQ ID NO: 1772 - DNA, 21 bp, Unknown
  Found in multiple species
cttctccatatgcactgatat

SEQ ID NO: 1773 - DNA, 21 bp, Unknown
  Found in multiple species
cttcgttcatttccttctcca

SEQ ID NO: 1774 - DNA, 21 bp, Unknown
  Found in multiple species
cttccccatttgtgccactaa

SEQ ID NO: 1775 - DNA, 21 bp, Unknown
  Found in multiple species
cttcccaagtggaattatgat

SEQ ID NO: 1776 - DNA, 21 bp, Unknown
  Found in multiple species
cttcataaccaccatcttctc

SEQ ID NO: 1777 - DNA, 21 bp, Unknown
  Found in multiple species
cttaattgcttcataaccacc

SEQ ID NO: 1778 - DNA, 21 bp, Unknown
  Found in multiple species
ctgttgagcacccatctgagc

SEQ ID NO: 1779 - DNA, 21 bp, Unknown
  Found in multiple species
ctggcggtctcgtgcttccct

SEQ ID NO: 1780 - DNA, 21 bp, Unknown
  Found in multiple species
ctggccagtgggaattccaag

SEQ ID NO: 1781 - DNA, 21 bp, Unknown
  Found in multiple species
ctggagatcatatctggtgtg

SEQ ID NO: 1782 - DNA, 21 bp, Unknown
  Found in multiple species
ctgatgctcattacaaagctt

SEQ ID NO: 1783 - DNA, 21 bp, Unknown
  Found in multiple species
ctgagcttcccaagtggaatt

SEQ ID NO: 1784 - DNA, 21 bp, Unknown
  Found in multiple species
ctgaacaagctggtgtggttc

SEQ ID NO: 1785 - DNA, 21 bp, Unknown
  Found in multiple species
ctcttggggtgttgccaatcg

SEQ ID NO: 1786 - DNA, 21 bp, Unknown
  Found in multiple species
ctctcatggtctttgtactgt

SEQ ID NO: 1787 - DNA, 21 bp, Unknown
  Found in multiple species
ctctaaacctgttgagcaccc

SEQ ID NO: 1788 - DNA, 21 bp, Unknown
  Found in multiple species
ctccatatgcactgatatggt

SEQ ID NO: 1789 - DNA, 21 bp, Unknown
  Found in multiple species
ctcagatgggtgctcaacagg

SEQ ID NO: 1790 - DNA, 21 bp, Unknown
  Found in multiple species
ctcaagcaattttcaaggatc

SEQ ID NO: 1791 - DNA, 21 bp, Unknown
  Found in multiple species
ctaaacctgttgagcacccat

SEQ ID NO: 1792 - DNA, 21 bp, Unknown
  Found in multiple species
cgttcatttccttctccatat

SEQ ID NO: 1793 - DNA, 21 bp, Unknown
  Found in multiple species
cgtggttgctctatccgtgtg

SEQ ID NO: 1794 - DNA, 21 bp, Unknown
  Found in multiple species
cgtggtggtaataatatcctt

SEQ ID NO: 1795 - DNA, 21 bp, Unknown
  Found in multiple species
cgtgacatatctgatgctcat

SEQ ID NO: 1796 - DNA, 21 bp, Unknown
  Found in multiple species
cggtctcgtgcttccctgtca

SEQ ID NO: 1797 - DNA, 21 bp, Unknown
  Found in multiple species
cggatagagcaaccacgattg

SEQ ID NO: 1798 - DNA, 21 bp, Unknown
  Found in multiple species
cgattggcaacaccccaagag

SEQ ID NO: 1799 - DNA, 21 bp, Unknown
  Found in multiple species
cgatgctggcggtctcgtgct

SEQ ID NO: 1800 - DNA, 21 bp, Unknown
  Found in multiple species
cgagaccgccagcatcgacac

SEQ ID NO: 1801 - DNA, 21 bp, Unknown
  Found in multiple species
ccttgtaatctgtgacacata

SEQ ID NO: 1802 - DNA, 21 bp, Unknown
  Found in multiple species
ccttgaaaattgcttgagggt

SEQ ID NO: 1803 - DNA, 21 bp, Unknown
  Found in multiple species
ccttcttaattgcttcataac

SEQ ID NO: 1804 - DNA, 21 bp, Unknown
  Found in multiple species
ccttctccatatgcactgata

SEQ ID NO: 1805 - DNA, 21 bp, Unknown
  Found in multiple species
cctgttgagcacccatctgag

SEQ ID NO: 1806 - DNA, 21 bp, Unknown
  Found in multiple species
cctggccagtgggaattccaa

SEQ ID NO: 1807 - DNA, 21 bp, Unknown
  Found in multiple species
cctcaagcaattttcaaggat

SEQ ID NO: 1808 - DNA, 21 bp, Unknown
  Found in multiple species
ccgtggtggtaataatatcct

SEQ ID NO: 1809 - DNA, 21 bp, Unknown
  Found in multiple species
ccctcaagcaattttcaagga

SEQ ID NO: 1810 - DNA, 21 bp, Unknown
  Found in multiple species
ccccatttgtgccactaatgt

SEQ ID NO: 1811 - DNA, 21 bp, Unknown
  Found in multiple species
cccatttgtgccactaatgtt

SEQ ID NO: 1812 - DNA, 21 bp, Unknown
  Found in multiple species
cccatctgagcttcccaagtg

SEQ ID NO: 1813 - DNA, 21 bp, Unknown
  Found in multiple species
cccactggccaggcataactt

SEQ ID NO: 1814 - DNA, 21 bp, Unknown
  Found in multiple species
cccacacggatagagcaacca

SEQ ID NO: 1815 - DNA, 21 bp, Unknown
  Found in multiple species
cccaagtggaattatgatggc

SEQ ID NO: 1816 - DNA, 21 bp, Unknown
  Found in multiple species
cccaaagtattgtagtttctg

SEQ ID NO: 1817 - DNA, 21 bp, Unknown
  Found in multiple species
ccatgagagaagatggtggtt

SEQ ID NO: 1818 - DNA, 21 bp, Unknown
  Found in multiple species
ccatcttctctcatggtcttt

SEQ ID NO: 1819 - DNA, 21 bp, Unknown
  Found in multiple species
ccatctgagcttcccaagtgg

SEQ ID NO: 1820 - DNA, 21 bp, Unknown
  Found in multiple species
ccatcataattccacttggga

SEQ ID NO: 1821 - DNA, 21 bp, Unknown
  Found in multiple species
ccatatgcactgatatggtcc

SEQ ID NO: 1822 - DNA, 21 bp, Unknown
  Found in multiple species
ccatatcagtgcatatggaga

SEQ ID NO: 1823 - DNA, 21 bp, Unknown
  Found in multiple species
ccagtgggaattccaagttgg

SEQ ID NO: 1824 - DNA, 21 bp, Unknown
  Found in multiple species
ccaggcataacttccccattt

SEQ ID NO: 1825 - DNA, 21 bp, Unknown
  Found in multiple species
ccagatatgatctccagcttc

SEQ ID NO: 1826 - DNA, 21 bp, Unknown
  Found in multiple species
ccacttgggaagctcagatgg

SEQ ID NO: 1827 - DNA, 21 bp, Unknown
  Found in multiple species
ccactggccaggcataacttc

SEQ ID NO: 1828 - DNA, 21 bp, Unknown
  Found in multiple species
ccacgtatgggtccatgtttg

SEQ ID NO: 1829 - DNA, 21 bp, Unknown
  Found in multiple species
ccacgattggcaacaccccaa

SEQ ID NO: 1830 - DNA, 21 bp, Unknown
  Found in multiple species
ccaccatcttctctcatggtc

SEQ ID NO: 1831 - DNA, 21 bp, Unknown
  Found in multiple species
ccacacggatagagcaaccac

SEQ ID NO: 1832 - DNA, 21 bp, Unknown
  Found in multiple species
ccaatcgtggttgctctatcc

SEQ ID NO: 1833 - DNA, 21 bp, Unknown
  Found in multiple species
ccaatcaccctcaataggctt

SEQ ID NO: 1834 - DNA, 21 bp, Unknown
  Found in multiple species
ccaagtggaattatgatggct

SEQ ID NO: 1835 - DNA, 21 bp, Unknown
  Found in multiple species
ccaacttggaattcccactgg

SEQ ID NO: 1836 - DNA, 21 bp, Unknown
  Found in multiple species
ccaaagtattgtagtttctgc

SEQ ID NO: 1837 - DNA, 21 bp, Unknown
  Found in multiple species
ccaaagcctattgagggtgat

SEQ ID NO: 1838 - DNA, 21 bp, Unknown
  Found in multiple species
catttccttctccatatgcac

SEQ ID NO: 1839 - DNA, 21 bp, Unknown
  Found in multiple species
cattagtggcacaaatgggga

SEQ ID NO: 1840 - DNA, 21 bp, Unknown
  Found in multiple species
catgagagaagatggtggtta

SEQ ID NO: 1841 - DNA, 21 bp, Unknown
  Found in multiple species
catcttctctcatggtctttg

SEQ ID NO: 1842 - DNA, 21 bp, Unknown
  Found in multiple species
catctgagcttcccaagtgga

SEQ ID NO: 1843 - DNA, 21 bp, Unknown
  Found in multiple species
catcataattccacttgggaa

SEQ ID NO: 1844 - DNA, 21 bp, Unknown
  Found in multiple species
catcagatatgtcacgtccaa

SEQ ID NO: 1845 - DNA, 21 bp, Unknown
  Found in multiple species
catatggagaaggaaatgaac

SEQ ID NO: 1846 - DNA, 21 bp, Unknown
  Found in multiple species
catatgcactgatatggtcct

SEQ ID NO: 1847 - DNA, 21 bp, Unknown
  Found in multiple species
catatctgatgctcattacaa

SEQ ID NO: 1848 - DNA, 21 bp, Unknown
  Found in multiple species
catatcagtgcatatggagaa

SEQ ID NO: 1849 - DNA, 21 bp, Unknown
  Found in multiple species
cataattccacttgggaagct

SEQ ID NO: 1850 - DNA, 21 bp, Unknown
  Found in multiple species
cataacttccccatttgtgcc

SEQ ID NO: 1851 - DNA, 21 bp, Unknown
  Found in multiple species
cataaccaccatcttctctca

SEQ ID NO: 1852 - DNA, 21 bp, Unknown
  Found in multiple species
cagtgcatatggagaaggaaa

SEQ ID NO: 1853 - DNA, 21 bp, Unknown
  Found in multiple species
cagtacaaagaccatgagaga

SEQ ID NO: 1854 - DNA, 21 bp, Unknown
  Found in multiple species
cagggtggagcagctactcaa

SEQ ID NO: 1855 - DNA, 21 bp, Unknown
  Found in multiple species
cagggaagcacgagaccgcca

SEQ ID NO: 1856 - DNA, 21 bp, Unknown
  Found in multiple species
caggcataacttccccatttg

SEQ ID NO: 1857 - DNA, 21 bp, Unknown
  Found in multiple species
cagattacaaggatattatta

SEQ ID NO: 1858 - DNA, 21 bp, Unknown
  Found in multiple species
cagatgggtgctcaacaggtt

SEQ ID NO: 1859 - DNA, 21 bp, Unknown
  Found in multiple species
cagatatgtcacgtccaaaag

SEQ ID NO: 1860 - DNA, 21 bp, Unknown
  Found in multiple species
cagatatgatctccagcttca

SEQ ID NO: 1861 - DNA, 21 bp, Unknown
  Found in multiple species
cagaaactacaatactttggg

SEQ ID NO: 1862 - DNA, 21 bp, Unknown
  Found in multiple species
cacttgggaagctcagatggg

SEQ ID NO: 1863 - DNA, 21 bp, Unknown
  Found in multiple species
cactggccaggcataacttcc

SEQ ID NO: 1864 - DNA, 21 bp, Unknown
  Found in multiple species
cacgtatgggtccatgtttga

SEQ ID NO: 1865 - DNA, 21 bp, Unknown
  Found in multiple species
cacggatagagcaaccacgat

SEQ ID NO: 1866 - DNA, 21 bp, Unknown
  Found in multiple species
cacgattggcaacaccccaag

SEQ ID NO: 1867 - DNA, 21 bp, Unknown
  Found in multiple species
cacgagaccgccagcatcgac

SEQ ID NO: 1868 - DNA, 21 bp, Unknown
  Found in multiple species
caccctcaataggctttggat

SEQ ID NO: 1869 - DNA, 21 bp, Unknown
  Found in multiple species
cacccatctgagcttcccaag

SEQ ID NO: 1870 - DNA, 21 bp, Unknown
  Found in multiple species
caccatcttctctcatggtct

SEQ ID NO: 1871 - DNA, 21 bp, Unknown
  Found in multiple species
caccagatatgatctccagct

SEQ ID NO: 1872 - DNA, 21 bp, Unknown
  Found in multiple species
cacagattacaaggatattat

SEQ ID NO: 1873 - DNA, 21 bp, Unknown
  Found in multiple species
cacacggatagagcaaccacg

SEQ ID NO: 1874 - DNA, 21 bp, Unknown
  Found in multiple species
cacaccagatatgatctccag

SEQ ID NO: 1875 - DNA, 21 bp, Unknown
  Found in multiple species
cacaaggaccatatcagtgca

SEQ ID NO: 1876 - DNA, 21 bp, Unknown
  Found in multiple species
cacaaatggggaagttatgcc

SEQ ID NO: 1877 - DNA, 21 bp, Unknown
  Found in multiple species
caattaagaaggcaattttga

SEQ ID NO: 1878 - DNA, 21 bp, Unknown
  Found in multiple species
caatcgtggttgctctatccg

SEQ ID NO: 1879 - DNA, 21 bp, Unknown
  Found in multiple species
caatcaccctcaataggcttt

SEQ ID NO: 1880 - DNA, 21 bp, Unknown
  Found in multiple species
caagtggaattatgatggctc

SEQ ID NO: 1881 - DNA, 21 bp, Unknown
  Found in multiple species
caaggatattattaccaccac

SEQ ID NO: 1882 - DNA, 21 bp, Unknown
  Found in multiple species
caaggaccatatcagtgcata

SEQ ID NO: 1883 - DNA, 21 bp, Unknown
  Found in multiple species
caagctttgtaatgagcatca

SEQ ID NO: 1884 - DNA, 21 bp, Unknown
  Found in multiple species
caacttggaattcccactggc

SEQ ID NO: 1885 - DNA, 21 bp, Unknown
  Found in multiple species
caaccacgattggcaacaccc

SEQ ID NO: 1886 - DNA, 21 bp, Unknown
  Found in multiple species
caaatggggaagttatgcctg

SEQ ID NO: 1887 - DNA, 21 bp, Unknown
  Found in multiple species
caaagcctattgagggtgatt

SEQ ID NO: 1888 - DNA, 21 bp, Unknown
  Found in multiple species
caaagaccatgagagaagatg

SEQ ID NO: 1889 - DNA, 21 bp, Unknown
  Found in multiple species
caaacatggacccatacgtgg

SEQ ID NO: 1890 - DNA, 21 bp, Unknown
  Found in multiple species
caaaattgccttcttaattgc

SEQ ID NO: 1891 - DNA, 21 bp, Unknown
  Found in multiple species
atttccttctccatatgcact

SEQ ID NO: 1892 - DNA, 21 bp, Unknown
  Found in multiple species
attggcaacaccccaagagaa

SEQ ID NO: 1893 - DNA, 21 bp, Unknown
  Found in multiple species
attgcttcataaccaccatct

SEQ ID NO: 1894 - DNA, 21 bp, Unknown
  Found in multiple species
attgccttcttaattgcttca

SEQ ID NO: 1895 - DNA, 21 bp, Unknown
  Found in multiple species
attgaagctggagatcatatc

SEQ ID NO: 1896 - DNA, 21 bp, Unknown
  Found in multiple species
attcccactggccaggcataa

SEQ ID NO: 1897 - DNA, 21 bp, Unknown
  Found in multiple species
attccacttgggaagctcaga

SEQ ID NO: 1898 - DNA, 21 bp, Unknown
  Found in multiple species
attcaaaattgccttcttaat

SEQ ID NO: 1899 - DNA, 21 bp, Unknown
  Found in multiple species
attagtggcacaaatggggaa

SEQ ID NO: 1900 - DNA, 21 bp, Unknown
  Found in multiple species
attacaaggatattattacca

SEQ ID NO: 1901 - DNA, 21 bp, Unknown
  Found in multiple species
attaagaaggcaattttgaat

SEQ ID NO: 1902 - DNA, 21 bp, Unknown
  Found in multiple species
atgtgtcacagattacaagga

SEQ ID NO: 1903 - DNA, 21 bp, Unknown
  Found in multiple species
atggtggttatgaagcaatta

SEQ ID NO: 1904 - DNA, 21 bp, Unknown
  Found in multiple species
atgggtgctcaacaggtttag

SEQ ID NO: 1905 - DNA, 21 bp, Unknown
  Found in multiple species
atggagaaggaaatgaacgaa

SEQ ID NO: 1906 - DNA, 21 bp, Unknown
  Found in multiple species
atggaccctgaggaccaggat

SEQ ID NO: 1907 - DNA, 21 bp, Unknown
  Found in multiple species
atgctggcggtctcgtgcttc

SEQ ID NO: 1908 - DNA, 21 bp, Unknown
  Found in multiple species
atgcctggccagtgggaattc

SEQ ID NO: 1909 - DNA, 21 bp, Unknown
  Found in multiple species
atgcactgatatggtccttgt

SEQ ID NO: 1910 - DNA, 21 bp, Unknown
  Found in multiple species
atgagcatcagatatgtcacg

SEQ ID NO: 1911 - DNA, 21 bp, Unknown
  Found in multiple species
atgagagaagatggtggttat

SEQ ID NO: 1912 - DNA, 21 bp, Unknown
  Found in multiple species
atgaagcaattaagaaggcaa

SEQ ID NO: 1913 - DNA, 21 bp, Unknown
  Found in multiple species
atcttctctcatggtctttgt

SEQ ID NO: 1914 - DNA, 21 bp, Unknown
  Found in multiple species
atctgatgctcattacaaagc

SEQ ID NO: 1915 - DNA, 21 bp, Unknown
  Found in multiple species
atctgagcttcccaagtggaa

SEQ ID NO: 1916 - DNA, 21 bp, Unknown
  Found in multiple species
atctctaaacctgttgagcac

SEQ ID NO: 1917 - DNA, 21 bp, Unknown
  Found in multiple species
atcgtggttgctctatccgtg

SEQ ID NO: 1918 - DNA, 21 bp, Unknown
  Found in multiple species
atccttgtaatctgtgacaca

SEQ ID NO: 1919 - DNA, 21 bp, Unknown
  Found in multiple species
atccttgaaaattgcttgagg

SEQ ID NO: 1920 - DNA, 21 bp, Unknown
  Found in multiple species
atcctggtcctcagggtccat

SEQ ID NO: 1921 - DNA, 21 bp, Unknown
  Found in multiple species
atcctccaatccaaatgtact

SEQ ID NO: 1922 - DNA, 21 bp, Unknown
  Found in multiple species
atccaaagcctattgagggtg

SEQ ID NO: 1923 - DNA, 21 bp, Unknown
  Found in multiple species
atcataattccacttgggaag

SEQ ID NO: 1924 - DNA, 21 bp, Unknown
  Found in multiple species
atcagtgcatatggagaagga

SEQ ID NO: 1925 - DNA, 21 bp, Unknown
  Found in multiple species
atcagatatgtcacgtccaaa

SEQ ID NO: 1926 - DNA, 21 bp, Unknown
  Found in multiple species
atcaccctcaataggctttgg

SEQ ID NO: 1927 - DNA, 21 bp, Unknown
  Found in multiple species
atatggagaaggaaatgaacg

SEQ ID NO: 1928 - DNA, 21 bp, Unknown
  Found in multiple species
atatgcactgatatggtcctt

SEQ ID NO: 1929 - DNA, 21 bp, Unknown
  Found in multiple species
atatctgatgctcattacaaa

SEQ ID NO: 1930 - DNA, 21 bp, Unknown
  Found in multiple species
atatccttgtaatctgtgaca

SEQ ID NO: 1931 - DNA, 21 bp, Unknown
  Found in multiple species
atatcagtgcatatggagaag

SEQ ID NO: 1932 - DNA, 21 bp, Unknown
  Found in multiple species
atagagcaaccacgattggca

SEQ ID NO: 1933 - DNA, 21 bp, Unknown
  Found in multiple species
ataccctcaagcaattttcaa

SEQ ID NO: 1934 - DNA, 21 bp, Unknown
  Found in multiple species
ataattccacttgggaagctc

SEQ ID NO: 1935 - DNA, 21 bp, Unknown
  Found in multiple species
ataatatccttgtaatctgtg

SEQ ID NO: 1936 - DNA, 21 bp, Unknown
  Found in multiple species
ataacttccccatttgtgcca

SEQ ID NO: 1937 - DNA, 21 bp, Unknown
  Found in multiple species
ataaccaccatcttctctcat

SEQ ID NO: 1938 - DNA, 21 bp, Unknown
  Found in multiple species
agttgagtagctgctccaccc

SEQ ID NO: 1939 - DNA, 21 bp, Unknown
  Found in multiple species
agttatgcctggccagtggga

SEQ ID NO: 1940 - DNA, 21 bp, Unknown
  Found in multiple species
agtggcacaaatggggaagtt

SEQ ID NO: 1941 - DNA, 21 bp, Unknown
  Found in multiple species
agtggaattatgatggctcaa

SEQ ID NO: 1942 - DNA, 21 bp, Unknown
  Found in multiple species
agtgcatatggagaaggaaat

SEQ ID NO: 1943 - DNA, 21 bp, Unknown
  Found in multiple species
agtagctgctccaccctgttt

SEQ ID NO: 1944 - DNA, 21 bp, Unknown
  Found in multiple species
agtacatttggattggaggat

SEQ ID NO: 1945 - DNA, 21 bp, Unknown
  Found in multiple species
agtacaaagaccatgagagaa

SEQ ID NO: 1946 - DNA, 21 bp, Unknown
  Found in multiple species
agggtggagcagctactcaac

SEQ ID NO: 1947 - DNA, 21 bp, Unknown
  Found in multiple species
agggaagcacgagaccgccag

SEQ ID NO: 1948 - DNA, 21 bp, Unknown
  Found in multiple species
aggcataacttccccatttgt

SEQ ID NO: 1949 - DNA, 21 bp, Unknown
  Found in multiple species
aggatattattaccaccacgg

SEQ ID NO: 1950 - DNA, 21 bp, Unknown
  Found in multiple species
aggaccatatcagtgcatatg

SEQ ID NO: 1951 - DNA, 21 bp, Unknown
  Found in multiple species
agctttgtaatgagcatcaga

SEQ ID NO: 1952 - DNA, 21 bp, Unknown
  Found in multiple species
agcttcccaagtggaattatg

SEQ ID NO: 1953 - DNA, 21 bp, Unknown
  Found in multiple species
agctggagatcatatctggtg

SEQ ID NO: 1954 - DNA, 21 bp, Unknown
  Found in multiple species
agctcagatgggtgctcaaca

SEQ ID NO: 1955 - DNA, 21 bp, Unknown
  Found in multiple species
agcctattgagggtgattgga

SEQ ID NO: 1956 - DNA, 21 bp, Unknown
  Found in multiple species
agccatcataattccacttgg

SEQ ID NO: 1957 - DNA, 21 bp, Unknown
  Found in multiple species
agcatcagatatgtcacgtcc

SEQ ID NO: 1958 - DNA, 21 bp, Unknown
  Found in multiple species
agcacgagaccgccagcatcg

SEQ ID NO: 1959 - DNA, 21 bp, Unknown
  Found in multiple species
agcacccatctgagcttccca

SEQ ID NO: 1960 - DNA, 21 bp, Unknown
  Found in multiple species
agcaattaagaaggcaatttt

SEQ ID NO: 1961 - DNA, 21 bp, Unknown
  Found in multiple species
agcaaccacgattggcaacac

SEQ ID NO: 1962 - DNA, 21 bp, Unknown
  Found in multiple species
agattcaaaattgccttctta

SEQ ID NO: 1963 - DNA, 21 bp, Unknown
  Found in multiple species
agattacaaggatattattac

SEQ ID NO: 1964 - DNA, 21 bp, Unknown
  Found in multiple species
agatggtggttatgaagcaat

SEQ ID NO: 1965 - DNA, 21 bp, Unknown
  Found in multiple species
agatgggtgctcaacaggttt

SEQ ID NO: 1966 - DNA, 21 bp, Unknown
  Found in multiple species
agatatgtcacgtccaaaaga

SEQ ID NO: 1967 - DNA, 21 bp, Unknown
  Found in multiple species
agatatgatctccagcttcaa

SEQ ID NO: 1968 - DNA, 21 bp, Unknown
  Found in multiple species
agagcaaccacgattggcaac

SEQ ID NO: 1969 - DNA, 21 bp, Unknown
  Found in multiple species
agagaagatggtggttatgaa

SEQ ID NO: 1970 - DNA, 21 bp, Unknown
  Found in multiple species
agaccatgagagaagatggtg

SEQ ID NO: 1971 - DNA, 21 bp, Unknown
  Found in multiple species
agaagatggtggttatgaagc

SEQ ID NO: 1972 - DNA, 21 bp, Unknown
  Found in multiple species
agaaccacaccagcttgttca

SEQ ID NO: 1973 - DNA, 21 bp, Unknown
  Found in multiple species
agaaactacaatactttggga

SEQ ID NO: 1974 - DNA, 21 bp, Unknown
  Found in multiple species
acttgggaagctcagatgggt

SEQ ID NO: 1975 - DNA, 21 bp, Unknown
  Found in multiple species
acttggaattcccactggcca

SEQ ID NO: 1976 - DNA, 21 bp, Unknown
  Found in multiple species
acttccccatttgtgccacta

SEQ ID NO: 1977 - DNA, 21 bp, Unknown
  Found in multiple species
actggccaggcataacttccc

SEQ ID NO: 1978 - DNA, 21 bp, Unknown
  Found in multiple species
actgaacaagctggtgtggtt

SEQ ID NO: 1979 - DNA, 21 bp, Unknown
  Found in multiple species
acgtgacatatctgatgctca

SEQ ID NO: 1980 - DNA, 21 bp, Unknown
  Found in multiple species
acggatagagcaaccacgatt

SEQ ID NO: 1981 - DNA, 21 bp, Unknown
  Found in multiple species
acgattggcaacaccccaaga

SEQ ID NO: 1982 - DNA, 21 bp, Unknown
  Found in multiple species
acgagaccgccagcatcgaca

SEQ ID NO: 1983 - DNA, 21 bp, Unknown
  Found in multiple species
acctgttgagcacccatctga

SEQ ID NO: 1984 - DNA, 21 bp, Unknown
  Found in multiple species
accctcaataggctttggatc

SEQ ID NO: 1985 - DNA, 21 bp, Unknown
  Found in multiple species
accctcaagcaattttcaagg

SEQ ID NO: 1986 - DNA, 21 bp, Unknown
  Found in multiple species
acccatctgagcttcccaagt

SEQ ID NO: 1987 - DNA, 21 bp, Unknown
  Found in multiple species
accatgagagaagatggtggt

SEQ ID NO: 1988 - DNA, 21 bp, Unknown
  Found in multiple species
accatcttctctcatggtctt

SEQ ID NO: 1989 - DNA, 21 bp, Unknown
  Found in multiple species
accatatcagtgcatatggag

SEQ ID NO: 1990 - DNA, 21 bp, Unknown
  Found in multiple species
accagatatgatctccagctt

SEQ ID NO: 1991 - DNA, 21 bp, Unknown
  Found in multiple species
accacgtatgggtccatgttt

SEQ ID NO: 1992 - DNA, 21 bp, Unknown
  Found in multiple species
accacgattggcaacacccca

SEQ ID NO: 1993 - DNA, 21 bp, Unknown
  Found in multiple species
accaccatcttctctcatggt

SEQ ID NO: 1994 - DNA, 21 bp, Unknown
  Found in multiple species
acattagtggcacaaatgggg

SEQ ID NO: 1995 - DNA, 21 bp, Unknown
  Found in multiple species
acatatctgatgctcattaca

SEQ ID NO: 1996 - DNA, 21 bp, Unknown
  Found in multiple species
acagtacaaagaccatgagag

SEQ ID NO: 1997 - DNA, 21 bp, Unknown
  Found in multiple species
acagggtggagcagctactca

SEQ ID NO: 1998 - DNA, 21 bp, Unknown
  Found in multiple species
acagggaagcacgagaccgcc

SEQ ID NO: 1999 - DNA, 21 bp, Unknown
  Found in multiple species
acagattacaaggatattatt

SEQ ID NO: 2000 - DNA, 21 bp, Unknown
  Found in multiple species
acacggatagagcaaccacga

SEQ ID NO: 2001 - DNA, 21 bp, Unknown
  Found in multiple species
acaaggatattattaccacca

SEQ ID NO: 2002 - DNA, 21 bp, Unknown
  Found in multiple species
acaaggaccatatcagtgcat

SEQ ID NO: 2003 - DNA, 21 bp, Unknown
  Found in multiple species
acaaatggggaagttatgcct

SEQ ID NO: 2004 - DNA, 21 bp, Unknown
  Found in multiple species
acaaagaccatgagagaagat

SEQ ID NO: 2005 - DNA, 21 bp, Unknown
  Found in multiple species
aattgcttcataaccaccatc

SEQ ID NO: 2006 - DNA, 21 bp, Unknown
  Found in multiple species
aattgccttcttaattgcttc

SEQ ID NO: 2007 - DNA, 21 bp, Unknown
  Found in multiple species
aattcccactggccaggcata

SEQ ID NO: 2008 - DNA, 21 bp, Unknown
  Found in multiple species
aattccacttgggaagctcag

SEQ ID NO: 2009 - DNA, 21 bp, Unknown
  Found in multiple species
aattaagaaggcaattttgaa

SEQ ID NO: 2010 - DNA, 21 bp, Unknown
  Found in multiple species
aatgagcatcagatatgtcac

SEQ ID NO: 2011 - DNA, 21 bp, Unknown
  Found in multiple species
aatcgtggttgctctatccgt

SEQ ID NO: 2012 - DNA, 21 bp, Unknown
  Found in multiple species
aatcaccctcaataggctttg

SEQ ID NO: 2013 - DNA, 21 bp, Unknown
  Found in multiple species
aatatccttgtaatctgtgac

SEQ ID NO: 2014 - DNA, 21 bp, Unknown
  Found in multiple species
aataatatccttgtaatctgt

SEQ ID NO: 2015 - DNA, 21 bp, Unknown
  Found in multiple species
aagttgagtagctgctccacc

SEQ ID NO: 2016 - DNA, 21 bp, Unknown
  Found in multiple species
aagttatgcctggccagtggg

SEQ ID NO: 2017 - DNA, 21 bp, Unknown
  Found in multiple species
aagtggaattatgatggctca

SEQ ID NO: 2018 - DNA, 21 bp, Unknown
  Found in multiple species
aaggatattattaccaccacg

SEQ ID NO: 2019 - DNA, 21 bp, Unknown
  Found in multiple species
aaggaccatatcagtgcatat

SEQ ID NO: 2020 - DNA, 21 bp, Unknown
  Found in multiple species
aagctttgtaatgagcatcag

SEQ ID NO: 2021 - DNA, 21 bp, Unknown
  Found in multiple species
aagctggagatcatatctggt

SEQ ID NO: 2022 - DNA, 21 bp, Unknown
  Found in multiple species
aagctcagatgggtgctcaac

SEQ ID NO: 2023 - DNA, 21 bp, Unknown
  Found in multiple species
aagcctattgagggtgattgg

SEQ ID NO: 2024 - DNA, 21 bp, Unknown
  Found in multiple species
aagcacgagaccgccagcatc

SEQ ID NO: 2025 - DNA, 21 bp, Unknown
  Found in multiple species
aagcaattaagaaggcaattt

SEQ ID NO: 2026 - DNA, 21 bp, Unknown
  Found in multiple species
aagatggtggttatgaagcaa

SEQ ID NO: 2027 - DNA, 21 bp, Unknown
  Found in multiple species
aagaccatgagagaagatggt

SEQ ID NO: 2028 - DNA, 21 bp, Unknown
  Found in multiple species
aacttggaattcccactggcc

SEQ ID NO: 2029 - DNA, 21 bp, Unknown
  Found in multiple species
aacttccccatttgtgccact

SEQ ID NO: 2030 - DNA, 21 bp, Unknown
  Found in multiple species
aactacaatactttgggaacc

SEQ ID NO: 2031 - DNA, 21 bp, Unknown
  Found in multiple species
aacctgttgagcacccatctg

SEQ ID NO: 2032 - DNA, 21 bp, Unknown
  Found in multiple species
aaccacgattggcaacacccc

SEQ ID NO: 2033 - DNA, 21 bp, Unknown
  Found in multiple species
aaccaccatcttctctcatgg

SEQ ID NO: 2034 - DNA, 21 bp, Unknown
  Found in multiple species
aaccacaccagcttgttcagt

SEQ ID NO: 2035 - DNA, 21 bp, Unknown
  Found in multiple species
aacattagtggcacaaatggg

SEQ ID NO: 2036 - DNA, 21 bp, Unknown
  Found in multiple species
aacagggtggagcagctactc

SEQ ID NO: 2037 - DNA, 21 bp, Unknown
  Found in multiple species
aaattgccttcttaattgctt

SEQ ID NO: 2038 - DNA, 21 bp, Unknown
  Found in multiple species
aaatggggaagttatgcctgg

SEQ ID NO: 2039 - DNA, 21 bp, Unknown
  Found in multiple species
aaagcctattgagggtgattg

SEQ ID NO: 2040 - DNA, 21 bp, Unknown
  Found in multiple species
aaagaccatgagagaagatgg

SEQ ID NO: 2041 - DNA, 21 bp, Unknown
  Found in multiple species
aaactacaatactttgggaac

SEQ ID NO: 2042 - DNA, 21 bp, Unknown
  Found in multiple species
aaacctgttgagcacccatct

SEQ ID NO: 2043 - DNA, 21 bp, Unknown
  Found in multiple species
aaacatggacccatacgtggt

SEQ ID NO: 2044 - DNA, 21 bp, Unknown
  Found in multiple species
aaacagggtggagcagctact

SEQ ID NO: 2045 - DNA, 21 bp, Unknown
  Found in multiple species
aaaattgccttcttaattgct

SEQ ID NO: 2046 - DNA, 41 bp, Amaranthus palmeri
gtctcgtgcttccctgtcaatcttcgttcatttccttctcc

SEQ ID NO: 2047 - DNA, 41 bp, Amaranthus palmeri
gaatatctgtgcagccctgtatcttttgttagtgggaatag

SEQ ID NO: 2048 - DNA, 40 bp, Amaranthus palmeri
aatatatctagcacaccagatatgatctccagcttcaatg

SEQ ID NO: 2049 - DNA, 40 bp, Amaranthus palmeri
gccatttaacattttgttggagcaaagtgtattcctgctc

SEQ ID NO: 2050 - DNA, 40 bp, Amaranthus palmeri
aggatattattaccaccacggaatggatccttgaaaattg

SEQ ID NO: 2051 - DNA, 41 bp, Amaranthus palmeri
tggctctccttgtggagtataggcatcacacataacaagga

SEQ ID NO: 2052 - DNA, 39 bp, Amaranthus palmeri
agtttctgcgatcattgatgtaacgacatatgggtccat

SEQ ID NO: 2053 - DNA, 41 bp, Amaranthus palmeri
gcctcctgtcttcaaaatatcctttgccattcttctccgtg

SEQ ID NO: 2054 - DNA, 41 bp, Amaranthus palmeri
gctgaagatcttttcagcattatgtctcttgttggttggga

SEQ ID NO: 2055 - DNA, 41 bp, Amaranthus palmeri
gtagccgccatcttccctcatcgatttagtgctgtaattgg

SEQ ID NO: 2056 - DNA, 41 bp, Amaranthus palmeri
ttgccctctccataagaggaaatgtgctccttgtggcggag

We claim:

1. A method of plant control comprising: treating a plant with a composition comprising a non-transcribable polynucleotide and a transfer agent, wherein said non-transcribable polynucleotide is from 18 to about 700 nucleotides in length and is at least 85% identical or at least 85% complementary to a glutamine synthetase (GS) gene sequence or to an RNA transcript of said GS gene sequence, wherein said GS gene sequence is selected from the group consisting of SEQ ID NOs:1-59 and a polynucleotide fragment thereof, wherein said transfer agent conditions the surface of said plant for permeation by said non-transcribable polynucleotide, and whereby said plant's growth, development, or reproductive ability is suppressed or delayed or said plant is more sensitive to a GS inhibitor herbicide as a result of said non-transcribable polynucleotide containing composition relative to a plant not treated with said composition.

2. The method as claimed in claim 1, wherein said transfer agent is an organosilicone surfactant composition or compound contained therein.

3. The method as claimed in claim 1, wherein said non-transcribable polynucleotide is selected from the group consisting of sense ssDNA, anti-sense ssDNA, sense ssRNA, anti-sense ssRNA, dsRNA, dsDNA, and dsDNA/RNA hybrids.

4. The method as claimed in claim 1, wherein said plant is selected from the group consisting of *Abutilon theophrasti, Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Ambrosia trifida, Ambrosia artemisiifolia, Chenopodium album, Commelina diffusa, Convulvulus arvensis, Conyza candensis, Lolium multiflorum, Euphorbia heterophylla, Kochia scoparia, Sorghum halepense* and *Digitaria sanguinalis*.

5. The method as claimed in claim 1, wherein said composition further comprises said GS inhibitor herbicide and said treating comprises external application to said plant with said composition.

6. The method as claimed in claim 5, wherein said composition further comprises one or more co-herbicides similar or different from said GS inhibitor herbicide.

7. The method as claimed in claim 1, wherein said composition comprises any combination of two or more of said non-transcribable polynucleotide or a fragment thereof and said treating comprises external application to said plant with said composition.

8. A composition comprising a non-transcribable polynucleotide and a transfer agent, wherein said non-transcribable polynucleotide is from 18 to about 700 nucleotides in length and is at least 85% identical or at least 85% complementary to a GS gene sequence, or to an RNA transcript of said GS gene sequence, wherein said GS gene sequence is selected from the group consisting of SEQ ID NOs:1-59 and a polynucleotide fragment thereof, wherein said transfer agent conditions the surface of a plant for permeation by said non-transcribable polynucleotide, and whereby said plant treated with said composition has its growth, development, or reproductive ability suppressed or delayed or said plant is more sensitive to a GS inhibitor herbicide as a result of said non-transcribable polynucleotide containing composition relative to a plant not treated with said composition.

9. The composition of claim 8, wherein said transfer agent is an organosilicone composition.

10. The composition of claim 8, wherein said non-transcribable polynucleotide is selected from the group consisting of SEQ ID NOs:60-1443 and a fragment thereof.

11. The composition of claim 8, wherein said non-transcribable polynucleotide is selected from the group consisting of SEQ ID NOs: 1444-2045 and a fragment thereof.

12. The composition of claim 8, further comprising said GS inhibitor herbicide.

13. The composition of claim 12, wherein said GS inhibitor herbicide is selected from the group consisting of glufosinate-ammonium and bialaphos.

14. The composition of claim 12, further comprising a co-herbicide.

15. A method of reducing expression of a GS gene in a plant comprising: external application to said plant of a composition comprising a non-transcribable polynucleotide and a transfer agent, wherein said non-transcribable polynucleotide is from 18 to about 700 nucleotides in length and is at least 85% identical or at least 85% complementary to a GS gene sequence or to an RNA transcript of said GS gene sequence wherein said GS gene sequence is selected from the group consisting of SEQ ID NOs:1-59 and a polynucleotide fragment thereof, wherein said transfer agent conditions the surface of said plant for permeation by said non-transcribable polynucleotide, and whereby said expression of said GS gene is reduced relative to a plant in which the composition was not applied.

16. The method as claimed in claim 15, wherein said transfer agent is an organosilicone compound.

17. The method as claimed in claim 15, wherein said non-transcribable polynucleotide is selected from the group consisting of sense ssDNA, anti-sense ssDNA, sense ssRNA, anti-sense ssRNA, dsRNA, dsDNA, and dsDNA/RNA hybrids.

18. A method of identifying non-transcribable polynucleotides useful in modulating GS gene expression when externally treating a plant comprising: a) providing a plurality of non-transcribable polynucleotides that are from 18 to about 700 nucleotides in length and are at least 85 percent identical or at least 85 percent complementary to a GS gene sequence selected from the group consisting of SEQ ID NOs:1-59; b) externally treating said plant with one or more of said non-transcribable polynucleotides and a transfer agent; and c) analyzing said plant or extract for modulation of GS gene expression, wherein said transfer agent conditions the surface of said plant for permeation by said one or more of said non-transcribable polynucleotides, and whereby said plant treated with said one or more of said non-transcribable polynucleotides and said transfer agent has its growth, development, or reproductive ability suppressed or delayed or said plant is more sensitive to a GS inhibitor herbicide as a result of said one or more of said non-transcribable polynucleotides and said transfer agent relative to a plant not treated with said one or more of said non-transcribable polynucleotides and said transfer agent.

19. The method as claimed in claim 18, wherein said plant is selected from the group consisting of Abutilon theophrasti, Amaranthus albus, Amaranthus chlorostachys, Amaranthus graecizans, Amaranthus hybridus, Amaranthus lividus, Amaranthus palmeri, Amaranthus rudis, Amaranthus spinosus, Amaranthus thunbergii, Ambrosia trifida, Ambrosia artemisiifolia, Chenopodium album, Commelina diffusa, Convulvulus arvensis, Conyza candensis, Lolium multiflorum, Euphorbia heterophylla, Kochia scoparia, Sorghum halepense and Digitaria sanguinalis.

20. The method as claimed in claim 18, wherein said GS gene expression is reduced relative to a plant not treated with said one or more of said non-transcribable polynucleotides and said transfer agent.

21. The method as claimed in claim 18, wherein said transfer agent is an organosilicone compound.

22. An agricultural chemical composition comprising an admixture of a non-transcribable polynucleotide, a GS inhibitor herbicide, and a co-herbicide, wherein said non-transcribable polynucleotide is from 18 to about 700 nucleotides in length and is at least 85% identical or at least 85% complementary to a portion of a GS gene sequence, or to a portion of an RNA transcript of said GS gene sequence, wherein said GS gene sequence is selected from the group consisting of SEQ ID NOs:1-59 and a polynucleotide fragment thereof, and whereby a plant treated with said composition has its growth, development, or reproductive ability suppressed or delayed or said plant is more sensitive to said GS inhibitor herbicide as a result of said non-transcribable polynucleotide containing composition relative to a plant not treated with said composition.

23. The agricultural chemical composition of claim 22, wherein said co-herbicide is selected from the group consisting of amide herbicides, arsenical herbicides, benzothiazole herbicides, benzoylcyclohexanedione herbicides, benzofuranyl alkylsulfonate herbicides, cyclohexene oxime herbicides, cyclopropylisoxazole herbicides, dicarboximide herbicides, dinitroaniline herbicides, dinitrophenol herbicides, diphenyl ether herbicides, dithiocarbamate herbicides, glycine herbicides, halogenated aliphatic herbicides, imidazolinone herbicides, inorganic herbicides, nitrile herbicides, organophosphorus herbicides, oxadiazolone herbicides, oxazole herbicides, phenoxy herbicides, phenylenediamine herbicides, pyrazole herbicides, pyridazine herbicides, pyridazinone herbicides, pyridine herbicides, pyrimidinediamine herbicides, pyrimidinyloxybenzylamine herbicides, quaternary ammonium herbicides, thiocarbamate herbicides, thiocarbonate herbicides, thiourea herbicides, triazine herbicides, triazinone herbicides, triazole herbicides, triazolone herbicides, triazolopyrimidine herbicides, uracil herbicides, and urea herbicides.

24. An agricultural chemical composition comprising an admixture of a non-transcribable polynucleotide, a GS inhibitor herbicide, and a pesticide, wherein said non-transcribable polynucleotide is from 18 to about 700 nucleotides in length and is at least 85% identical or at least 85% complementary to a portion of a GS gene sequence, or to a portion of an RNA transcript of said GS gene sequence, wherein said GS gene sequence is selected from the group consisting of SEQ ID NOs: 1-59 and a polynucleotide fragment thereof, and whereby a plant treated with said composition has its growth, development, or reproductive ability suppressed or delayed or said plant is more sensitive to said GS inhibitor herbicide as a result of said non-transcribable polynucleotide containing composition relative to a plant not treated with said composition.

25. The agricultural chemical composition of claim 24, wherein said pesticide is selected from the group consisting of insecticides, fungicides, nematicides, bactericides, acaricides, growth regulators, chemosterilants, semiochemicals, repellents, attractants, pheromones, feeding stimulants, and biopesticides.

26. A composition comprising a non-transcribable polynucleotide and a transfer agent, wherein said non-transcribable polynucleotide is selected from the group consisting of SEQ ID NOs: 2046-2056 and a complement or polynucleotide fragment thereof, wherein said transfer agent conditions the surface of a plant for permeation by said non-transcribable polynucleotide, and whereby said plant treated with said composition has its growth, development, or reproductive ability suppressed or delayed or said plant is more sensitive to a GS inhibitor herbicide as a result of said non-transcribable polynucleotide containing composition relative to a plant not treated with said composition.

27. The method of claim 1, wherein said non-transcribable polynucleotide is an RNA polynucleotide.

28. The composition of claim 8, wherein said non-transcribable polynucleotide is an RNA polynucleotide.

* * * * *